US007906326B2

(12) United States Patent
Bentwich

(10) Patent No.: US 7,906,326 B2
(45) Date of Patent: Mar. 15, 2011

(54) BIOINFORMATICALLY DETECTABLE GROUP OF NOVEL REGULATORY OLIGONUCLEOTIDES ASSOCIATED WITH ALZHEIMER'S DISEASE AND USES THEREOF

(75) Inventor: Itzhak Bentwich, Kfar Daniel (IL)

(73) Assignee: Rosetta Genomics Ltd., Rehovot (IL)

( * ) Notice: Subject to any disclaimer, the term of this patent is extended or adjusted under 35 U.S.C. 154(b) by 568 days.

(21) Appl. No.: 10/708,204

(22) Filed: Feb. 16, 2004

(65) Prior Publication Data
US 2005/0222399 A1 Oct. 6, 2005

Related U.S. Application Data

(63) Continuation-in-part of application No. 10/649,653, filed on Aug. 28, 2003, now abandoned, and a continuation-in-part of application No. 10/651,227, filed on Aug. 29, 2003, now abandoned, and a continuation-in-part of application No. 10/707,147, filed on Nov. 24, 2003, and a continuation-in-part of application No. 10/604,985, filed on Aug. 29, 2003, now abandoned, and a continuation-in-part of application No. 10/604,926, filed on Aug. 27, 2003, now abandoned, and a continuation-in-part of application No. 10/604,727, filed on Aug. 13, 2003, now abandoned, and a continuation-in-part of application No. 10/604,726, filed on Aug. 13, 2003, and a continuation-in-part of application No. 10/707,975, filed on Jan. 29, 2004, now abandoned, and a continuation-in-part of application No. 10/707,980, filed on Jan. 29, 2004.

(60) Provisional application No. 60/468,251, filed on May 7, 2003, now abandoned.

(30) Foreign Application Priority Data

Nov. 26, 2003 (WO) .................. PCT/IL03/00998

(51) Int. Cl.
*C07H 21/02* (2006.01)
*C07H 21/04* (2006.01)
*C12Q 1/68* (2006.01)
*C12N 15/00* (2006.01)
(52) U.S. Cl. ....... 435/320.1; 435/6; 536/23.1; 536/24.1; 536/24.31; 536/24.5
(58) Field of Classification Search .................. None
See application file for complete search history.

(56) References Cited

U.S. PATENT DOCUMENTS

| 5,541,308 | A  | * | 7/1996  | Hogan et al. ............... 536/23.1 |
| 6,573,099 | B2 |   | 6/2003  | Graham |
| 6,582,908 | B2 | * | 6/2003  | Fodor et al. ............... 435/6 |
| 6,812,339 | B1 | * | 11/2004 | Venter et al. ............... 536/24.31 |
| 2002/0086356 | A1 |   | 7/2002  | Tuschl et al. |
| 2003/0108923 | A1 |   | 6/2003  | Tuschl et al. |
| 2003/0228691 | A1 |   | 12/2003 | Lewis et al. |
| 2005/0059005 | A1 | * | 3/2005  | Tuschl et al. ............... 435/6 |
| 2006/0105360 | A1 | * | 5/2006  | Croce et al. ............... 435/6 |

FOREIGN PATENT DOCUMENTS

| WO | WO 01/75164     |    | 2/2003 |
| WO | WO 03/029459    |    | 4/2003 |
| WO | WO 03029459  A2 | *  | 4/2003 |
| WO | WO 2004/009779  |    | 1/2004 |

OTHER PUBLICATIONS

Krutzfeldt et al. (2006) Nature Genetics 38:514-519.*
New England Biolabs 1998/99 Catalog, cover page, p. 121 and 284.*
Bentwich (2005) FEBS Lett. 579:5904-5910.*
Bentwich et al. (2005) FEBS Lett. 579:5904-5910.*
Martin et al. (2007) J. Biosci. 32:1049-1052.*
Maziere et al. (2007) Drug Discovery Today 12:452-458.*
Smalheiser et al. (2006) Methods Mol. Biol. 342:115-127.*
Zhao et al. (1997) GenBank Acc. No. AQ420078.*
Buck et al. (Biotechniques (1999) 27(3): 526-538).*
Lagos-Quintana et al. (2002) Curr. Biol. 12:735-739.*
Kim et al. (2004) PNAS 101:360365, including Table 2.*
Cullen (2004) "Derivation and function of small interfering RNAs and microRNAs" Viral Res. 102:3-9.*
Brown (1998) "In situ hybridization with riboprobes: An overview for veterinary pathologists" Vet. Pathol. 35:159-1.*
Ashrafi, K., F. Y. Chang, J. L. Watts, A. G. Fraser, R. S. Kamath, J. Ahringer and G. Ruvkun. Genome-wide RNAi analysis of *Caenorhabditis elegans* fat regulatory genes Nature Jan. 16, 2003 268-272 421.
Kamath, R. S., A. G. Fraser, Y. Dong, G. Poulin, R. Durbin, M. Gotta, A. Kanapin, N. Le Bot, S. Moreno, M. Sohrmann, D. P. Welchman, P. Zipperlen and J. Ahringer. Systematic functional analysis of the *Caenorhabditis elegans* genome using RNAi Nature Jan. 16, 2003 231-237 421.

(Continued)

*Primary Examiner* — Sean R McGarry
(74) *Attorney, Agent, or Firm* — Teddy C. Scott, Jr.; Ron Galant; Polsinelli Shughart PC

(57) ABSTRACT

The present invention relates to a first group of novel oligonucleotides, here identified as genomic address messenger or GAM oligonucleotides, and a second group of novel operon-like polynucleotides, here identified as genomic record or GR polynucleotides. GAM oligonucleotides selectively inhibit translation of known target genes, many of which are known to be involved in various diseases. Nucleic acid molecules are provided respectively encoding 1708 GAM oligonucleotides, and 246 GR polynucleotides as are vectors and probes both comprising the nucleic acid molecules, and methods and systems for detecting GAM oligonucleotides and GR polynucleotide and specific functions and utilities thereof, for detecting expression of GAM oligonucleotides and GR polynucleotides and for selectively enhancing and selectively inhibiting translation of the respective target genes thereof.

6 Claims, 31 Drawing Sheets

OTHER PUBLICATIONS

Tuschl, T. Functional genomics: RNA sets the standard Nature Jan. 16, 2003 220-221 421.

Iyer, L. M., E. V. Koonin and L. Aravind. Evolutionary connection between the catalytic subunits of DNA-dependent RNA polymerases and eukaryotic RNA-dependent RNA polymerases and the origin of RNA polymerases BMC Struct Biol Jan. 28, 2003 1 3.

Kawasaki, H., E. Suyama, M. Iyo and K. Taira. siRNAs generated by recombinant human Dicer induce specific and significant but target site-independent gene silencing in human cells Nucleic Acids Res Feb. 1, 2003 981-987 31.

Reiner, A., D. Yekutieli and Y. Benjamini. Identifying differentially expressed genes using false discovery rate controlling procedures Bioinformatics Feb. 12, 2003 368-375 19.

Doench, J. G., C. P. Petersen and P. A. Sharp. siRNAs can function as miRNAs Genes Dev Feb. 15, 2003 438-442 17.

Carmichael, G. G. Antisense starts making more sense Nat Biotechnol Apr. 2003 371-372 21.

Colciaghi, F., E. Marcello, B. Borroni, M. Zimmermann, C. Caltagirone, F. Cattabeni, A. Padovani and M. Di Luca. Platelet APP, ADAM 10 and BACE alterations in the early stages of Alzheimer disease Neurology Feb. 10, 2004 498-501 62.

Boden, D., O. Pusch, R. Silbermann, F. Lee, L. Tucker and B. Ramratnam. Enhanced gene silencing of HIV-1 specific siRNA using microRNA designed hairpins Nucleic Acids Res Feb. 13, 2004 1154-1158 32.

Bohnsack, M. T., K. Czaplinski and D. Gorlich. Exportin 5 is a RanGTP-dependent dsRNA-binding protein that mediates nuclear export of pre-miRNAs Rna Feb. 2004 185-191 10.

Demidov, V. V. and M. D. Frank-Kamenetskii. Two sides of the coin: affinity and specificity of nucleic acid interactions Trends Biochem Sci Feb. 2004 62-71 29.

Maquat, L. E. Nonsense-mediated mRNA decay: splicing, translation and mRNP dynamics Nat Rev Mol Cell Biol Feb. 2004 89-99 5.

Nijholt, I., N. Farchi, M. Kye, E. H. Sklan, S. Shoham, B. Verbeure, D. Owen, B. Hochner, J. Spiess, H. Soreq and T. Blank. Stress-induced alternative splicing of acetylcholinesterase results in enhanced fear memory and long-term potentiation Mol Psychiatry Feb. 2004 174-183 9.

Sengupta, P. Taking sides in the nervous system with miRNA Nat Neurosci Feb. 2004 100-102 7.

Zerhouni, B., J. A. Nelson and K. Saha. Isolation of CD4-independent primary human immunodeficiency virus type 1 isolates that are syncytium inducing and acutely cytopathic for CD8+ lymphocytes J Virol Feb. 2004 1243-1255 78.

Jin, P., D. C. Zarnescu, S. Ceman, M. Nakamoto, J. Mowrey, T. A. Jongens, D. L. Nelson, K. Moses and S. T. Warren. Biochemical and genetic interaction between the fragile X mental retardation protein and the microRNA pathway Nat Neurosci Feb. 2004 113-117 7.

Lai, E. C., C. Wiel and G. M. Rubin. Complementary miRNA pairs suggest a regulatory role for miRNA:miRNA duplexes Rna Feb. 2004 171-175 10.

Metzler, M., M. Wilda, K. Busch, S. Viehmann and A. Borkhardt. High expression of precursor microRNA-155/BIC RNA in children with Burkitt lymphoma Genes Chromosomes Cancer Feb. 2004 167-169 39.

Ohno K, et al. Choline acetyltransferase mutations cause myasthenia syndrome associated with episodic apnea in humans. PNAS, 2001;98(4):2017-22.

Doench JG and Sharp PA. Genes Dev, 2004;18(5):504-11.

Lai EC, Predicting and validating microRNA targets, Genome Biology 2004;5:115.

Vella MC, Architecture of a validated microRNA::target interaction, Chemistry & Biology 2004;11:1619-23.

Brennecke J, Principles of MicroRNA-target recognition, PLoS Biology 2005;3(3):e85.

Lim LP, Microarray analysis shows that some micro RNAs downregulate large numbers of target mRNAs, Nature 2005;433(7027):769-73.

Ikari Y, a1-Proteinase Inhibitor, a1-Antichymotrypsin, and a2-Macroglobulin Are theAntiapoptotic Factors of Vascular Smooth Muscle Cells, J Biol Chem 2001;276(15):11798-803.

Inui, T et al. Cathepsin K Antisense Oligodeoxynucleotide Inhibits Osteoclastic Bone Resorption. J Biol Chem, 1997;272(13):8109-12.

Morin, R.D. et al., "Application of massively parallel sequencing to microRNA profiling and discovery of human embryonic stem cells," Genome Res., 2008;18:610-21.

Zamore, P.D., et al., "RNAi: Double-Stranded RNA Directs the ATP-Dependent Cleavage of mRNA at 21 to 23 Nucleotide Intervals," Cell, 2000;101:25-33.

Elbashir, S.M. et al., "RNA interference is mediated by 21- and 22-nucleotide RNAs", Genes and Development, 2001;15:188-200.

Lim, L.P. et al., "The microRNAs of *Caenorhabditis elegans*," Genes & Dev., 2003;17:991-1008.

Bartel, D.P., "MicroRNAs: Genomics, Biogenesis, Mechanism, and Function," Cell, 2004;116:281-97.

* cited by examiner

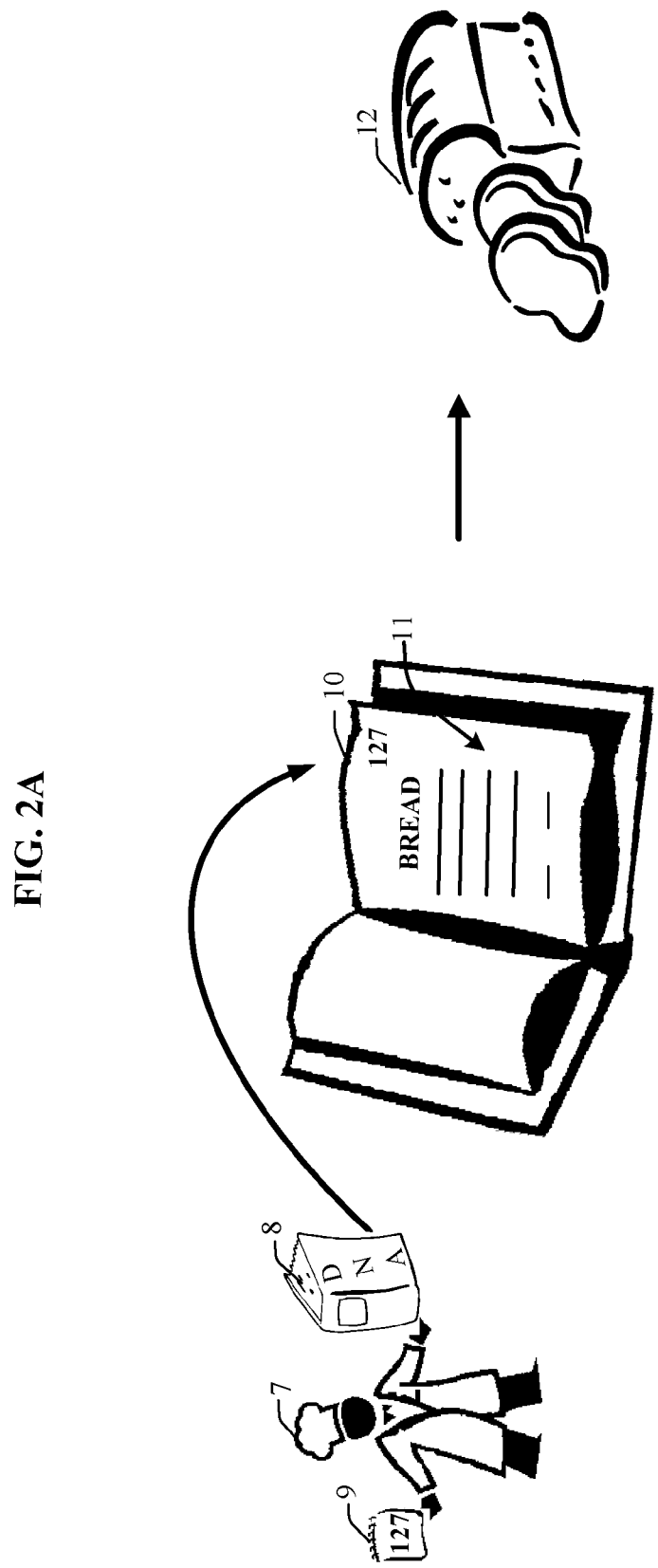

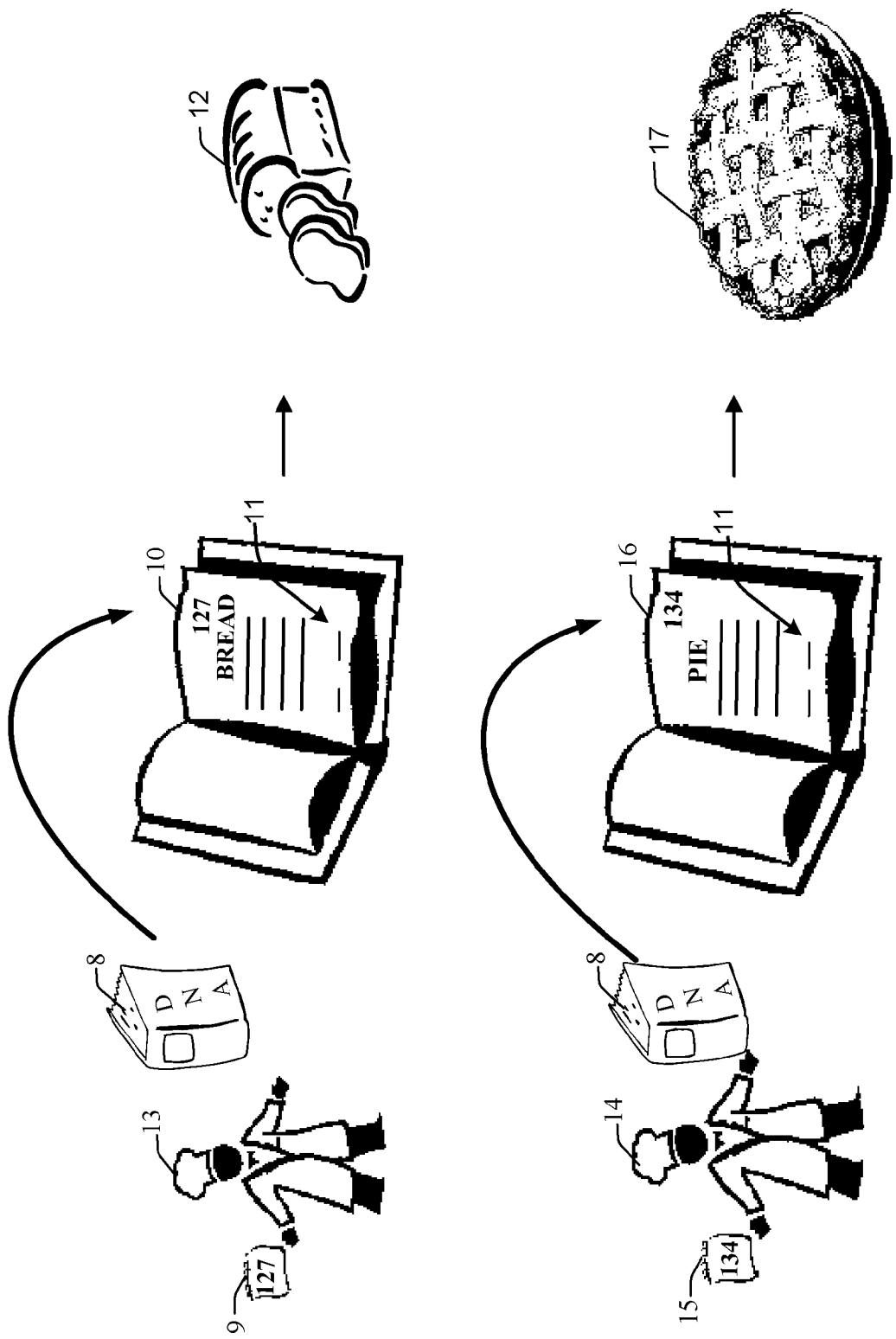

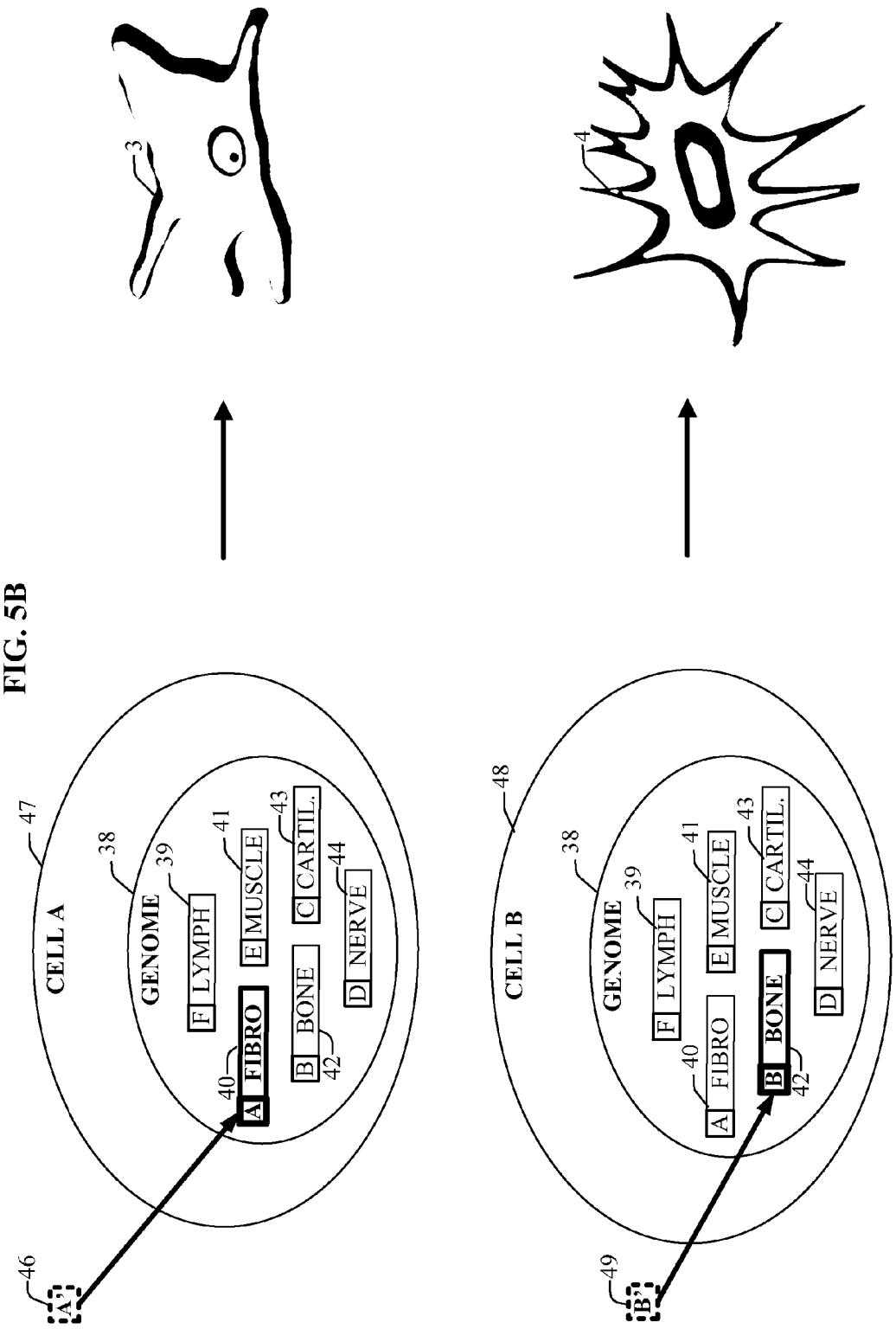

FIG. 21B

| GAM Detection Accuracy Group | Number of published hairpins | Precision on hairpin mixture | Lab validation of Human GAMs | | | Hairpins in RNA databases | Hairpins of the present invention |
| --- | --- | --- | --- | --- | --- | --- | --- |
| | | | Sent | Positive | % success | | |
| A | 228 | 76% | 101 | 37 | 37% | 2821 | 1419 |
| B | 135 | 41% | 56 | 13 | 23% | 19950 | 333 |
| C | 27 | 18% | 7 | 1 | 14% | 11765 | 18 |
| D | 20 | 10% | 4 | 1 | 25% | 7876 | 2 |
| Overall | 410 | 44% | 168 | 52 | 31% | 42416 | 1708 |

FIG. 22B

| NUMBER | NAME | SEQUENCE (5 TO 3) | SEQUENCED | SEQ ID NO |
|---|---|---|---|---|
| 1 | hsa-miR-21 | TAGCTTATCAGACTGATGTTGA | + | 7352 |
| 2 | hsa-miR-27b | TTCACAGTGGCTAAGTTCTGCA | + | 7353 |
| 3 | hsa-miR-186 | AAAGAATTCTCCTTTTGGGCTT | + | 7354 |
| 4 | hsa-miR-93 | AAGTGCTGTTCGTGCAGGTAGT | + | 7355 |
| 5 | hsa-miR-26a | TCAAGTAATCCAGGATAGGCTG | + | 7356 |
| 6 | hsa-miR-191 | AACGGAATCCCAAAAGCAGCTG | + | 7357 |
| 7 | hsa-miR-31 | GGCAAGATGCTGGCATAGCTGT | + | 7358 |
| 8 | hsa-miR-92 | TATTGCACTTGTCCCGGCCTGT | + | 7359 |
| 9 | GAM3418-A | ATCACATTGCCAGGGATTACCA | + | 7360 |
| 10 | GAM4426-A | GAAGTTTGAAGCCTGTTGTTCA | + | 7361 |
| 11 | GAM281-A | CACTGCACTCCAGCCTGGGCAA |  | 7362 |
| 12 | GAM7553-A | TAGGTAGTTTCCTGTTGTTGGG | + | 7363 |
| 13 | GAM5385-A | TCACAGTGAACCGGTCTCTTTC | + | 7364 |
| 14 | GAM2608-A | TAAGGTGCATCTAGTGCAGTTA |  | 7365 |
| 15 | GAM1032-A | CTAGACTGAAGCTCCTTGAGGA | + | 7366 |
| 16 | GAM3431-A | TAATACTGCCGGGTAATGATGG |  | 7367 |
| 17 | GAM7933-A | TAGCAGCACATAATGGTTTGAA |  | 7368 |
| 18 | GAM3298-A | AAAGTGCTCATAGTGCAGGTAG | + | 7369 |
| 19 | GAM7080-A | TTTCCACAGCGGCCAATTCTTC | + | 7370 |
| 20 | GAM895-A | AGCTGCCAGTTGAAGAACATTT |  | 7371 |
| 21 | GAM3770-A | AAGTTAAGAGCTCCCAGGCCTG |  | 7372 |
| 22 | GAM337162-A | ACTGCACTCCAGCCTGGGCAAC | + | 7373 |
| 23 | GAM8678-A | GTGTTCCAGGAAGTCGTCTTGA |  | 7374 |
| 24 | GAM2033-A | TCAAGCTCATTCCTCTAACCTC |  | 7375 |
| 25 | GAM7776-A | CATTGCACTCCAGCCTGGGCAA | + | 7376 |
| 26 | GAM8145-A | ACATGATCTCCTCACTCTAGGA |  | 7377 |
| 27 | GAM25-A | AATTGCTTGAACCCAGGAAGTG | + | 7378 |
| 28 | GAM7352-A | TGTTTAAGTAGCTTATTTATCT |  | 7379 |
| 29 | GAM337624-A | TCTAAGAGAAAGGAAGTTCAGA | + | 7380 |
| 30 | GAM1479-A | GAAGGCAGTAGGTTGTATAGTT | + | 7381 |
| 31 | GAM2270-A | ATCACATTGCCAGTGATTACCC | + | 7382 |
| 32 | GAM7591-A | TTGGAGTAATTCAGTATAGGTT | + | 7383 |
| 33 | GAM8285-A | AGTAGACAGTGGCAACATAGTC |  | 7384 |
| 34 | GAM6773-A | CTAGCCTGTTTGTCCTCACCCC | + | 7385 |
| 35 | GAM336818-A | TGAGGTGGGATCCCGAGGCC | + | 7386 |
| 36 | GAM336487 -A | TGGCTAGGTAAGGGAAG | + | 7387 |
| 37 | GAM337620-A | AATCATCATTATTTTGAAGTTTA | + | 7388 |
| 38 | GAM336809-A | T AAGGCATTTTT A TGGT | + | 7389 |
| 39 | GAM5346-A | GCTGTTGTTAAGGGCACTTGGG |  | 7390 |
| 40 | GAM8554-A | TTCATGGGAGCAGGTGGTACAG |  | 7391 |
| 41 | GAM2701-A | ACTGCACTCCAGTCTGGGTGAC |  | 7392 |
| 42 | GAM7957-A | TCACTGCAACCTCTGCCTCCCG |  | 7393 |
| 43 | GAM391-A | CAGATCACATCCATCCGTCACC |  | 7394 |
| 44 | GAM6633-A | GCACTCAAGCCTGGGTTACAGA |  | 7395 |
| 45 | GAM19 | AGAGAGTGGCAGGTCTGTTCCT |  | 7396 |
| 46 | GAM8358-A | GATGAGGCAGCACTTGGG |  | 7397 |
| 47 | GAM3229-A | TGAGGTGGGAGAATTGCTTGAA |  | 7398 |
| 48 | GAM7052-A | CATGTAATCCCAGCTACTCAGG |  | 7399 |
| 49 | GAM3027-A (mmu-MIR-29c) | TAGCACCATTTGAAATCGGTTA | + | 7400 |
| 50 | GAM21 (m mu - MIR-130b) | CAGTGCAATGATGAAAGGGCAT | + | 7401 |
| 51 | GAM oligonucleotide (mmu-MIR 30e) | TGTAAACATCCTTGACTGGAAG | + | 7402 |

FIG. 24A

EST72223 (705 nt.)

Chr.X

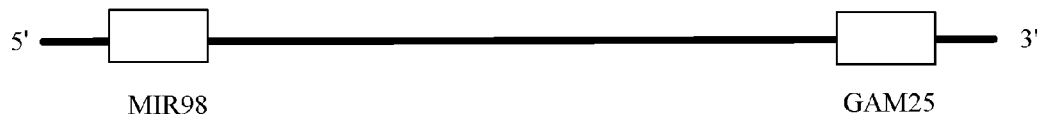

MIR98            GAM25

EST72223 sequence:

CCCTTATTAGAGGATTCTGCTCATGCCAGG**GTGAGGTAGTAAGTTGTATTG
TTG**TGGGGTAGGGATATTAGGCCCCAATTAGAAGATAACTATACAACT    MIR98
TACTACTTTCCCTGGTGTGTGGCATATTCACACTTAGTCTTAGCAGTGTTGCC
TCCATCAGACAAAGTTGTAGATGTTCCTTGGATAATTTGGACTGGAAGAAAGA
GACATGGAAGGGGACAGATGGTGTTTAGGGTGAGGCAGATGTCATTATAAAGT
GACTTGTCTTTCATTAATTGGAGCATATAATTATTTTACCTTTGGGCATGAACTC
ATTTTGCTATTCTTCAACTGTGTAATGATTGCATTTTATTAGTAATAGAACAGGA
ATGTGTGCAAGGGAATGGAAAGCATACTTTAAGAATTTTGGGCCAGGCGCGGT
GGTTCATGCCTGTAATCCCAGCATTTTTGGGAGGCCGAGGCGGGTGGATCAC
CTGAGGTCAGGAGTTCGAGACCAACCTGGCCAACACGGCGAAACCCCGCCTC
TACTCAAATACAAAAATTAGCCAGGCTTGGTGACACTCGCCTGTGGTCCCAGC
TACTCAGGAGGCTGAGGCAGGAGAATTGCTTGAACCCAGGAAGTGGAG    GAM25
GCTTCAGTGAGCTGAGAACACGCCACTGCACTCCAGTCCTGGGCAAC
AGAGCAAGACTCTGTCTCAGGAAAAAAAAAG

FIG. 24B

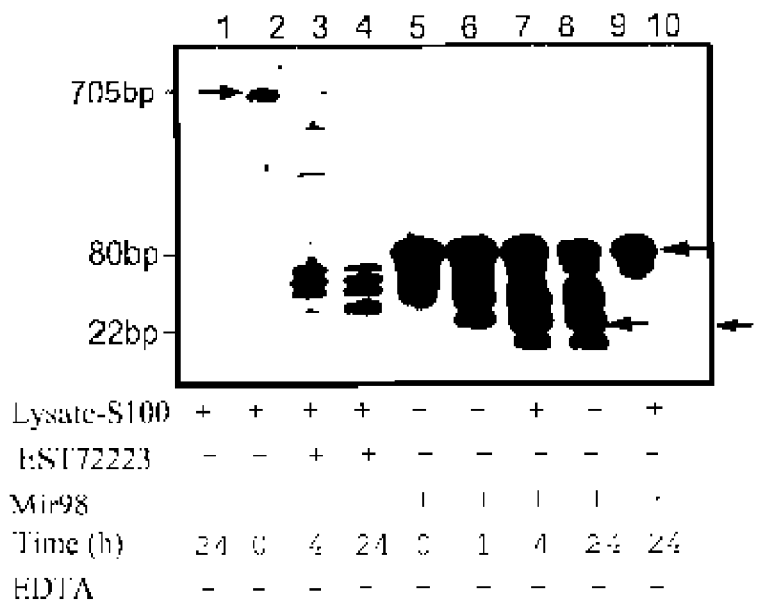

BIOINFORMATICALLY DETECTABLE GROUP OF NOVEL REGULATORY OLIGONUCLEOTIDES ASSOCIATED WITH ALZHEIMER'S DISEASE AND USES THEREOF

CROSS REFERENCE TO RELATED APPLICATIONS

This application is a continuation in part of and claims priority from the following patent applications, the disclosures of which applications are all hereby incorporated herein by reference: U.S. patent application Ser. No. 10/707,975 filed 29 Jan. 2004, U.S. patent application Ser. No. 10/707,147 filed 24 Nov. 2003, U.S. patent application Ser. No. 10/707,147 filed 24 Nov. 2003, U.S. patent application Ser. No. 10/604,985 filed 29 Aug. 2003, U.S. patent application Ser. No. 10/651,227 filed 29 Aug. 2003, U.S. patent application Ser. No. 10/649,653 filed 28 Aug. 2003, U.S. patent application Ser. No. 10/604,926 filed 27 Aug. 2003, U.S. patent application Ser. No. 10/604,726 filed 13 Aug. 2003, U.S. patent application Ser. No. 10/604,727 filed 13 Aug. 2003, and U.S. Provisional Patent Application Ser. No. 60/468,251 filed 2007 May 2003. This application also claims priority from International application Number: PCT/IL 03/00970, filed 16 Nov. 2003, the disclosure of which application is hereby incorporated herein by reference. All of the aforesaid patent applications are entitled "Bioinformatically Detectable Group of Novel Regulatory Genes and Uses Thereof"; This application also claims priority from U.S. patent application Ser. No. 10/707,980 filed 29 Jan. 2004, entitled "Bioinformatically Detectable Group of Novel Regulatory Oligonucleotides and Uses Thereof"; U.S. patent application Ser. No. 10/707,980, filed 29 Jan. 2004, entitled "Bioinformatically Detectable Group of Novel Regulatory Oligonucleotides and Uses Thereof" is a continuation in part of and claims priority from the following patent applications, the disclosures of which applications are all hereby incorporated herein by reference: U.S. patent application Ser. No. 10/707,147 filed 24 Nov. 2003, U.S. patent application Ser. No. 10/707,147 filed 24 Nov. 2003, U.S. patent application Ser. No. 10/604,985 filed 29 Aug. 2003, U.S. patent application Ser. No. 10/651,227 filed 29 Aug. 2003, U.S. patent application Ser. No. 10/649,653 filed 28 Aug. 2003, U.S. patent application Ser. No. 10/604,926 filed 27 Aug. 2003, U.S. patent application Ser. No. 10/604,726 filed 13 Aug. 2003, U.S. patent application Ser. No. 10/604,727 filed 13 Aug. 2003, and U.S. Provisional patent application Ser. No. 60/468,251 filed 7 May 2003. This application also claims priority from International application Number: PCT/IL 03/00970, filed 16 Nov. 2003, the disclosure of which application is hereby incorporated herein by reference. All of the aforesaid patent applications are entitled "Bioinformatically Detectable Group of Novel Regulatory Genes and Uses Thereof"; U.S. patent application Ser. No. 10/707,975, filed 29 Jan. 2004, entitled "Bioinformatically Detectable Group of Novel Regulatory Genes and Uses Thereof" is a continuation in part of and claims priority from the following patent applications, the disclosures of which applications are all hereby incorporated herein by reference: U.S. patent application Ser. No. 10/707,147 filed 24 Nov. 2003, U.S. patent application Ser. No. 10/707,147 filed 24 Nov. 2003, U.S. patent application Ser. No. 10/604,985 filed 29 Aug. 2003, U.S. patent application Ser. No. 10/651,227 filed 29 Aug. 2003, U.S. patent application Ser. No. 10/649,653 filed 28 Aug. 2003, U.S. patent application Ser. No. 10/604,926 filed 27 Aug. 2003, U.S. patent application Ser. No. 10/604,726 filed 13 Aug. 2003, U.S. patent application Ser. No. 10/604,727 filed 13 Aug. 2003, and U.S. Provisional patent application Ser. No. 60/468,251 filed 7 May 2003. This application also claims priority from International application Number: PCT/IL 03/00970, filed 16 Nov. 2003, the disclosure of which application is hereby incorporated herein by reference. All of the aforesaid patent applications are entitled "Bioinformatically Detectable Group of Novel Regulatory Genes and Uses Thereof"; U.S. patent application Ser. No. 10/707,147, filed 24 Nov. 2003, entitled "Bioinformatically Detectable Group of Novel Regulatory Genes and Uses Thereof" is a continuation in part of and claims priority from the following patent applications, the disclosures of which applications are all hereby incorporated herein by reference: U.S. patent application Ser. No. 10/604,985 filed 29 Aug. 2003, U.S. patent application Ser. No. 10/651,227 filed 29 Aug. 2003, U.S. patent application Ser. No. 10/649,653 filed 28 Aug. 2003, U.S. patent application Ser. No. 10/604,926 filed 27 Aug. 2003, U.S. patent application Ser. No. 10/604,726 filed 13 Aug. 2003, U.S. patent application Ser. No. 10/604,727 filed 13 Aug. 2003, and U.S. Provisional patent application Ser. No. 60/468,251 filed 7 May 2003. This application also claims priority from International application Number: PCT/IL 03/00970, filed 16 Nov. 2003, the disclosure of which application is hereby incorporated herein by reference. All of the aforesaid patent applications are entitled "Bioinformatically Detectable Group of Novel Regulatory Genes and Uses Thereof"; International application Number: PCT/IL 03/00970, filed 16 Nov. 2003, entitled "Bioinformatically Detectable Group of Novel Regulatory Genes and Uses Thereof" is a continuation in part of and claims priority from the following patent applications, the disclosures of which applications are all hereby incorporated herein by reference: U.S. patent application Ser. No. 10/604,985 filed 29 Aug. 2003, U.S. patent application Ser. No. 10/651,227 filed 29 Aug. 2003, U.S. patent application Ser. No. 10/649,653 filed 28 Aug. 2003, U.S. patent application Ser. No. 10/604,926 filed 27 Aug. 2003, U.S. patent application Ser. No. 10/604,726 filed 13 Aug. 2003, U.S. patent application Ser. No. 10/604,727 filed 13 Aug. 2003, U.S. Provisional patent application Ser. No. 60/468,251 filed 7 May 2003, and U.S. patent application Ser. No. 10/345,201 filed 16 Jan. 2003. All of the aforesaid patent applications are entitled "Bioinformatically Detectable Group of Novel Regulatory Genes and Uses Thereof"; U.S. patent application Ser. No. 10/604,985, filed 29 Aug. 2003, entitled "Bioinformatically is a continuation of U.S. Provisional patent application Ser. No. 60/468,251, filed 7 May 2003, entitled "Bioinformatically Detectable Group of Novel Regulatory Genes and Uses Thereof" the disclosure of which is hereby incorporated herein and claims priority therefrom; and is a continuation in part of and claims priority from the following patent applications, the disclosures of which applications are all hereby incorporated herein by reference: U.S. patent application Ser. No. 10/651,227 filed 29 Aug. 2003, U.S. patent application Ser. No. 10/649,653 filed 28 Aug. 2003, U.S. patent application Ser. No. 10/604,926 filed 27 Aug. 2003, U.S. patent application Ser. No. 10/604,726 filed 13 Aug. 2003, U.S. patent application Ser. No. 10/604,727 filed 13 Aug. 2003, U.S. patent application Ser. No. 10/345,201 filed 16 Jan. 2003, U.S. patent application Ser. No. 10/321,503 filed 18 Dec. 2002, U.S. patent application Ser. No. 10/310,914 filed 2006 Dec. 2002, and U.S. patent application Ser. No. 10/293,338 filed 14 Nov. 2002. All of the aforesaid patent applications are entitled "Bioinformatically Detectable Group of Novel Regulatory Genes and Uses Thereof"; U.S. patent application Ser. No. 10/604,926, filed 27 Aug. 2003, entitled "Bioinformatically Detectable Group of Novel Regulatory Genes and Uses Thereof" is a continuation of U.S. patent application Ser. No. 10/345,201, filed 16 Jan. 2003, entitled "Bioinformatically Detectable Group of Novel Regulatory Genes and Uses Thereof" the disclosure of which is hereby incorporated herein and claims priority therefrom; and is a continuation in part of and claims priority from the following patent applications, the disclosures of which applications are all hereby incorporated herein by reference: U.S. patent application Ser. No. 10/604,726 filed 13 Aug. 2003, U.S. patent application Ser. No. 10/604,727 filed 13 Aug. 2003, U.S. Provisional patent application Ser. No. 60/468,251 filed 7 May 2003, U.S. patent application Ser. No. 10/321,503 filed 18 Dec. 2002, U.S. patent application Ser. No. 10/310,914 filed 6 Dec. 2002, and U.S. patent application Ser. No. 10/293,338 filed 14 Nov. 2002. All of the aforesaid patent applications are entitled "Bioinformatically Detectable Group of Novel Regulatory Genes and Uses Thereof"; U.S. patent application Ser. No. 10/649,653, filed 28 Aug. 2003, entitled "Bioinformatically Detectable Group of Novel Regulatory Genes and Uses Thereof" is a continuation of U.S. patent application Ser. No. 10/321,503, filed 18 Dec. 2002, entitled "Bioinformatically Detectable Group of Novel Regulatory Genes and Uses Thereof"; the disclosure of which is hereby incorporated herein and claims priority therefrom; and is a continuation in part of and claims priority from the following patent applications, the disclosures of which applications are all hereby incorporated herein by reference: U.S. patent application Ser. No. 10/604,926 filed 27 Aug. 2003, U.S. patent application Ser. No. 10/604,726 filed 13 Aug. 2003, U.S. patent application Ser. No. 10/604,727 filed 13 Aug. 2003, U.S. Provisional patent application Ser. No. 60/468,251 filed 7 May 2003, U.S. patent application Ser. No. 10/321,503 filed 18 Dec. 2002, U.S. patent application Ser. No. 10/310,914 filed 6 Dec. 2002, and U.S. patent application Ser. No. 10/293,338 filed 14 Nov. 2002. All of the aforesaid patent applications are entitled "Bioinformatically Detectable Group of Novel Regulatory Genes and Uses Thereof"; U.S. patent application Ser. No. 10/651,227, filed 29 Aug. 2003, entitled "Bioinformatically Detectable Group of Novel Regulatory Genes and Uses Thereof" is a continuation of U.S. patent application Ser. No. 10/310,914, filed 6 Dec. 2002, entitled "Bioinformatically Detectable Group of Novel Regulatory Genes and Uses Thereof"; the disclosure of which is hereby incorporated herein and claims priority therefrom; and is a continuation in part of and claims priority from the following patent applications, the disclosures of which applications are all hereby incorporated herein by reference: U.S. patent application Ser. No. 10/604,985 filed 29 Aug. 2003, U.S. patent application Ser. No. 10/649,653 filed 28 Aug. 2003, U.S. patent application Ser. No. 10/604,926 filed 27 Aug. 2003, U.S. patent application Ser. No. 10/604,726 filed 13 Aug. 2003, U.S. patent application Ser. No. 10/604,727 filed 13 Aug. 2003, U.S. Provisional Patent Application Ser. No. 60/468,251 filed 7 May 2003, U.S. patent application Ser. No. 10/345,201 filed 16 Jan. 2003, U.S. patent application Ser. No. 10/321,503 filed 18 Dec. 2002, U.S. patent application Ser. No. 10/310,914 filed 6 Dec. 2002, and U.S. patent application Ser. No. 10/293,338 filed 14 Nov. 2002. All of the aforesaid patent applications are entitled "Bioinformatically Detectable Group of Novel Regulatory Genes and Uses Thereof"; U.S. patent application Ser. Nos. 10/604,727 and 10/604,726, filed 13 Aug. 2003, entitled "Bioinformatically Detectable Group of Novel Regulatory Genes and Uses Thereof" are a continuation of U.S. patent application Ser. No. 10/293,338, filed 14 Nov. 2002, entitled "Bioinformatically Detectable Group of Novel Regulatory Genes and Uses Thereof", the disclosure of which is hereby incorporated herein and claims priority therefrom; and are a continuation in part of and claims priority from the following patent applications, the disclosures of which applications are all hereby incorporated herein by reference: U.S. Provisional Patent Application Ser. No. 60/468,251 filed 7 May 2003, U.S. patent application Ser. No. 10/345,201 filed 16 Jan. 3, U.S. patent application Ser. No. 10/321,503 filed 18 Dec. 2002, U.S. patent application Ser. No. 10/310,914 filed 6 Dec. 2002, and U.S. patent application Ser. No. 10/293,338 filed 14 Nov. 2002. All of the aforesaid patent applications are entitled "Bioinformatically Detectable Group of Novel Regulatory Genes and Uses Thereof"; U.S. Provisional Patent Application Ser. No. 60/468,251, filed 7 May 2003, entitled "Bioinformatically Detectable Group of Novel Regulatory Genes and Uses Thereof" is a continuation in part of and claims priority from the following patent applications, the disclosures of which applications are all hereby incorporated herein by reference: U.S. patent application Ser. No. 10/345,201 filed 16 Jan. 2003, U.S. patent application Ser. No. 10/321,503 filed 18 Dec. 2002, U.S. patent application Ser. No. 10/310,914 filed 6 Dec. 2002, and U.S. patent application Ser. No. 10/293,338 filed 14 Nov. 2002. All of the aforesaid patent applications are entitled "Bioinformatically Detectable Group of Novel Regulatory Genes and Uses Thereof"; U.S. patent application Ser. No. 10/345,201, filed 16 Jan. 2003, entitled "Bioinformatically Detectable Group of Novel Regulatory Genes and Uses Thereof" is a continuation in part of and claims priority from the following patent applications, the disclosures of which applications are all hereby incorporated herein by reference: U.S. patent application Ser. No. 10/321,503 filed 18 Dec. 2002, U.S. patent application Ser. No. 10/310,914 filed 6 Dec. 2002, and U.S. patent application Ser. No. 10/293,338 filed 14 Nov. 2002. All of the aforesaid patent applications are entitled "Bioinformatically Detectable Group of Novel Regulatory Genes and Uses Thereof"; U.S. patent application Ser. No. 10/321,503, filed 18 Dec. 2002, entitled "Bioinformatically Detectable Group of Novel Regulatory Genes and Uses Thereof" is a continuation in part of and claims priority from the following patent applications, the disclosures of which applications are all hereby incorporated herein by reference: U.S. patent application Ser. No. 10/310,914 filed 6 Dec. 2002, and U.S. patent application Ser. No. 10/293,338 filed 14 Nov. 2002. All of the aforesaid patent applications are entitled "Bioinformatically Detectable Group of Novel Regulatory Genes and Uses Thereof"; U.S. patent application Ser. No. 10/310,914, filed 6 Dec. 2002, entitled "Bioinformatically Detectable Group of Novel Regulatory Genes and Uses Thereof" is a continuation in part of U.S. patent application Ser. No. 10/293,338, filed 14 Nov. 2002, entitled "Bioinformatically Detectable Group of Novel Regulatory Genes and Uses Thereof", the disclosure of which is hereby incorporated by reference and claims priority therefrom.

REFERENCES CITED

Altschul, S. F., Gish, W., Miller, W., Myers, E. W., and Lipman, D. J. (1990). Basic local alignment search tool. J. Mol. Biol. 215, 403-410.

Ambros, V., Lee, R. C., Lavanway, A., Williams, P. T., and Jewell, D. (2003). MicroRNAs and Other Tiny Endogenous RNAs in C. elegans 1. Curr. Biol. 13, 807-818.

Calin, G. A., Dumitru, C. D., Shimizu, M., Bichi, R., Zupo, S., Noch, E., Aldler, H., Rattan, S., Keating, M., Rai, K., Rassenti, L., Kipps, T., Negrini, M., Bullrich, F., and Croce, C. M. (2002). Frequent deletions and downregulation of micro-RNA genes miR15 and miR16 at 13q14 in chronic lymphocytic leukemia. Proc. Natl. Acad. Sci. U.S.A.

Dan Gusfield, Algorithms on strings, trees, and sequences: computer science and computational biology, Cambridge University Press, 1997.

Elbashir, S. M., Lendeckel, W., and Tuschl, T. (2001). RNA interference is mediated by 21- and 22-nucleotide RNAs. Genes Dev. 15, 188-200.

Gibbs, W. W. (2003). The unseen genome: gems among the junk. Sci. Am. 289, 46-53.

Gussow, D. and Clackson, T. (1989). Direct clone characterization from plaques and colonies by the polymerase chain reaction. Nucleic Acids Res. 17, 4000.

Hamosh A, Scott A F, Amberger J, Bocchini C, Valle D and McKusick V A. (2002). Online Mendelian Inheritance in Man (OMIM), a knowledgebase of human genes and genetic disorders. Nucleic Acids Res. 30: 52-55.

Jenuth J. P. (2000). The NCBI. Publicly available tools and resources on the Web. Methods Mol. Biol. 132, 301-312.

Kirkness, E. F. and Kerlavage, A. R. (1997). The TIGR human cDNA database. Methods Mol. Biol. 69, 261-268.

Lagos-Quintana, M., Rauhut, R., Lendeckel, W., and Tuschl, T. (2001). Identification of novel genes coding for small expressed RNAs. Science 294, 853-858.

Lau, N. C., Lim, L. P., Weinstein, E. G., and Bartel, D. P. (2001). An abundant class of tiny RNAs with probable regulatory roles in *Caenorhabditis elegans*. Science 294, 858-862.

Lau, N. C. and Bartel, D. P. (2003). Censors of the genome. Sci. Am. 289, 34-41.

Lim, L. P., Glasner, M. E., Yekta, S., Burge, C. B., and Bartel, D. P. (2003). Vertebrate microRNA genes. Science 299, 1540.

Mathews, D. H., Sabina, J., Zuker, M., and Turner, D. H. (1999). Expanded sequence dependence of thermodynamic parameters improves prediction of RNA secondary structure. J. Mol. Biol. 288, 911-940.

Metzler, M., Wilda, M., Busch, K., Viehmann, S., and Borkhardt, A. (2004). High expression of precursor micro RNA-155/BIC RNA in children with Burkitt lymphoma. Genes Chromosomes. Cancer 39, 167-169.

Michael, M. Z., O'Connor, S. M., Holst Pellekaan, N. G., Young, G. P., and James, R. J. (2003). Reduced accumulation of specific microRNAs in colorectal neoplasia. Mol. Cancer Res. 1, 882-891.

Reinhart, B. J., Slack, F. J., Basson, M., Pasquinelli, A. E., Bettinger J. C., Rougvie, A. E., Horvitz, H. R., and Ruvkun, G. (2000). The 21-nucleotide let-7 RNA regulates developmental timing in *Caenorhabditis elegans*. Nature 403, 901-906.

Southern, E. M. (1992). Detection of specific sequences among DNA fragments separated by gel electrophoresis. 1975. Biotechnology 24, 122-139.

Tom M. Mitchell, Machine Learning, McGraw Hill, 1997.

Wightman, B., Ha, I., and Ruvkun, G. (1993). Posttranscriptional regulation of the heterochronic gene lin-14 by lin-4 mediates temporal pattern formation in *C. elegans*. Cell 75, 855-862.

Zhang, H., Kolb, F. A., Brondani, V., Billy, E., and Filipowicz, W. (2002). Human Dicer preferentially cleaves dsRNAs at their termini without a requirement for ATP. EMBO J. 21, 5875-5885.

Zuker, M. (2003). Mfold web server for nucleic acid folding and hybridization prediction. Nucleic Acids Res. 31, 3406-3415.

BACKGROUND OF INVENTION

1. Field of the Invention

The present invention relates to a group of bioinformatically detectable novel oligonucleotides, here identified as Genomic Address Messenger or GAM oligonucleotides, which are believed to be related to the micro RNA (miRNA) group of oligonucleotides.

2. Description of Prior Art

Micro RNAs (miRNA), are short ~22 nt non-coding regulatory RNA oligonucleotides, found in a wide range of species, believed to function as specific gene translation repressors, sometimes involved in cell-differentiation.

The ability to detect novel miRNAs is limited by the methodologies used to detect such oligonucleotides. All miRNAs identified so far either present a visibly discernable whole body phenotype, as do Lin-4 and Let-7 (Wightman, B., Ha, I., and Ruvkun, G., Cell 75:855-862 (1993); Reinhart et al. Nature 403: 901-906 (2000)), or produce sufficient quantities of RNA so as to be detected by the standard molecular biological techniques.

Studies reporting miRNAs (Lau et al., Science 294:858-862 (2001), Lagos-Quintana et al., Science 294: 853-858 (2001)) discovered 93 miRNAs in several species, by sequencing a limited number of clones (300 by Lau and 100 by Lagos-Quintana) of small segments (i.e. size fractionated) RNA. MiRNAs detected in these studies therefore, represent the more prevalent among the miRNA oligonucleotide family, and can not be much rarer than 1% of all small ~20 nt-long RNA oligonucleotides.

The aforesaid studies provide no basis for detection of miRNA oligonucleotides which either do not present a visually discernable whole body phenotype, or are rare (e.g. rarer than 0.1% of all size fractionated ~20 nt-long RNA segments expressed in the tissues examined), and therefore do not produce significant enough quantities of RNA so as to be detected by standard biological techniques.

Previous studies on miRNAs and their relation to diseases have suggested potential involvement of several miRNAs in various type of cancers; It has been suggested that mir-15 and mir-16 are associated with B-cell chronic lymphocytic leukemia (Calin, G. A at al., Proc. Natl. Acad. Sci. U.S.A., 2002). More recently, researchers have shown strong evidence for involvement of mir-143 and mir-145 in colorectal neoplasia (Michael, M. Z. et al., Mol. Cancer Res. 1: 882-891 (2003)). Mietzler and colleagues have demonstrated that mir-155, which is located on BIC locus, is highly and differentially expressed in pediatric Burkit lymphoma patients (Metzler, M. at al. Cancer 39: 167-169 (2004)). Involvement of miRNAs in Alzheimers disease is unknown.

The following U.S. patents relate to bioinformatic detection of genes: U.S. Pat. No. 6,369,195, entitled "Prostate-specific gene for diagnosis, prognosis and management of prostate cancer", and U.S. Pat. No. 6,291,666 entitled "Spike tissue-specific promoter", each of which is hereby incorporated by reference herein.

BRIEF DESCRIPTION OF SEQUENCE LISTING, LARGE TABLES AND COMPUTER PROGRAM LISTING

LENGTHY TABLES

The patent contains a lengthy table section. A copy of the table is available in electronic form from the USPTO web site (http://seqdata.uspto.gov/?pageRequest=docDetail&DocID=US07906326B2). An electronic copy of the table will also be available from the USPTO upon request and payment of the fee set forth in 37 CFR 1.19(b)(3).

A sequence listing in accordance with 37 C.F.R. §§1.821-1.825 is attached to the present invention and contained in a file named "SeqList.txt" (1222 KB, created Sep. 24, 2008), and is hereby incorporated by reference.

Large tables relating to genomic sequences are attached to the present application, appear in 11 table files (size, creation date), incorporated herein: TABLE1.TXT (215 KB, 16 Feb. 2004); TABLE2.TXT (16,358 KB, 16 Feb. 2004); TABLE3.TXT (134 KB, 16 Feb. 2004); TABLE4.TXT (945 KB, 16 Feb. 2004), TABLE5.TXT (113 KB, 16 Feb. 2004), TABLE6.TXT (189 KB, 16 Feb. 2004) and TABLE7.TXT (3,335 KB, 16 Feb. 2004), TABLE8.TXT (12,240 KB, 16 Feb. 2004), TABLE9.TXT (34,018 KB, 16 Feb. 2004), TABLE10.TXT (1,300 KB, 16 Feb. 2004) and TABLE11.TXT (2 KB, 16 Feb. 2004), all of which are incorporated by reference herein.

A computer program listing of a computer program constructed and operative in accordance with a preferred embodiment of the present invention is enclosed on an electronic medium in computer readable form, and is hereby incorporated by reference herein The computer program listing is contained in 6 files, the name, sizes and creation date of which are as follows: AUXILARY_FILES.TXT (117K, 14 Nov. 2003); BINDING_SITE_SCORING.TXT (17K, 14 Nov. 2003); EDIT_DISTANCE.TXT (144K, 24 Nov. 2003); FIRST-K.TXT (96K, 24 Nov. 2003); HAIRPIN_PREDICTION.TXT (47K, 14 Nov. 2003); TWO_PHASED_SIDE_SELECTOR.TXT (4K, 14 Nov. 2003); and TWO_PHASED_ PREDICTOR.TXT (74K, 14 Nov. 2003).

SUMMARY OF INVENTION

The present invention relates to an isolated nucleic acid selected from the group consisting of (a) SEQ ID NO: 6527, (b) a DNA encoding the nucleic acid of (a), wherein the DNA is identical in length to (a); and (c) the complement of (a) or (b), wherein the complement is identical in length to the nucleic acid of (a) or (b). Additionally, the present invention relates to vectors or probes comprising a human insert, wherein the human insert consists of the nucleic acid selected from the group consisting of (a) SEQ ID NO: 6527, (b) a DNA encoding the nucleic acid of (a), wherein the DNA is identical in length to (a); and (c) the complement of (a) or (b), wherein the complement is identical in length to the nucleic acid of (a) or (b), and wherein the vector or probe comprises no other insert but the nucleic acid as described above.

The present invention also relates to an isolated nucleic acid selected from the group consisting of (a) SEQ ID NO: 15, (b) a DNA encoding the nucleic acid of (a), wherein the DNA is identical in length to (a); and (c) the complement of (a) or (b), wherein the complement is identical in length to the nucleic acid of (a) or (b). Additionally, the present invention relates to vectors or probes comprising a human insert, wherein the human insert consists of the nucleic acid selected from the group consisting of (a) SEQ ID NO: 15, (b) a DNA encoding the nucleic acid of (a), wherein the DNA is identical in length to (a); and (c) the complement of (a) or (b), wherein the complement is identical in length to the nucleic acid of (a) or (b), and wherein the vector or probe comprises no other insert but the nucleic acid as described above.

BRIEF DESCRIPTION OF DRAWINGS

FIGS. 2, 3 and 4 are schematic diagrams which, when taken together, provide an analogy that illustrates a conceptual model of the present invention, addressing the genomic differentiation enigma;

FIGS. 5A and 5B are schematic diagrams, which when taken together, illustrate a 'genomic records' concept of the conceptual model of the present invention, addressing the genomic differentiation enigma;

FIG. 21B is a table summarizing laboratory validation results which validate efficacy of a bioinformatic oligonucleotide detection system constructed and operative in accordance with a preferred embodiment of the present invention;

FIG. 22A and FIG. 22B are a picture and a summary table of laboratory results validating the expression of 43 novel oligonucleotides detected by a bioinformatic oligonucleotide detection engine constructed and operative in accordance with a preferred embodiment of the present invention, thereby validating the efficacy of the oligonucleotide detection engine of the present invention;

FIG. 24A, is an annotated sequence of EST72223 (SEQ ID NO: 7414) comprising known miRNA oligonucleotide MIR98 and novel oligonucleotide GAM25 PRECURSOR detected by the oligonucleotide detection system of the present invention. Additionally annotated in EST72223 are the miRNA-98 hairpin in bold (SEQ ID NO: 7415), the sequence of the mature miRNA-98 in bold and underline (SEQ ID NO: 7416), the sequence of the GAM25 hairpin in bold (SEQ ID NO: 7417), and the sequence of the mature miRNA of GAM25 in bold and underline (SEQ ID NO: 7418).

FIGS. 24B, 24C and 24D are pictures of laboratory results, which when taken together demonstrate laboratory confirmation of expression of known oligonucleotide MIR98 and of novel bioinformatically detected GAM25 RNA respectively, both of FIG. 24A, thus validating the bioinformatic oligonucleotide detection system of the present invention.

BRIEF DESCRIPTION OF SEQUENCES

A Sequence Listing of genomic sequences of the present invention designated SEQ ID NO: 1 through SEQ ID NO: 7,351 is attached to this application, and is hereby incorporated herein. The genomic listing comprises the following nucleotide sequences: nucleotide sequences of 1708 GAMs precursors of respective novel oligonucleotides of the present invention; nucleotide sequences of 2686 GAM RNA oligonucleotides of respective novel DNA oligonucleotides of the present invention; and nucleotide sequences of 2957 target gene binding sites of respective novel oligonucleotides of the present invention.

DETAILED DESCRIPTION

Figure 1:
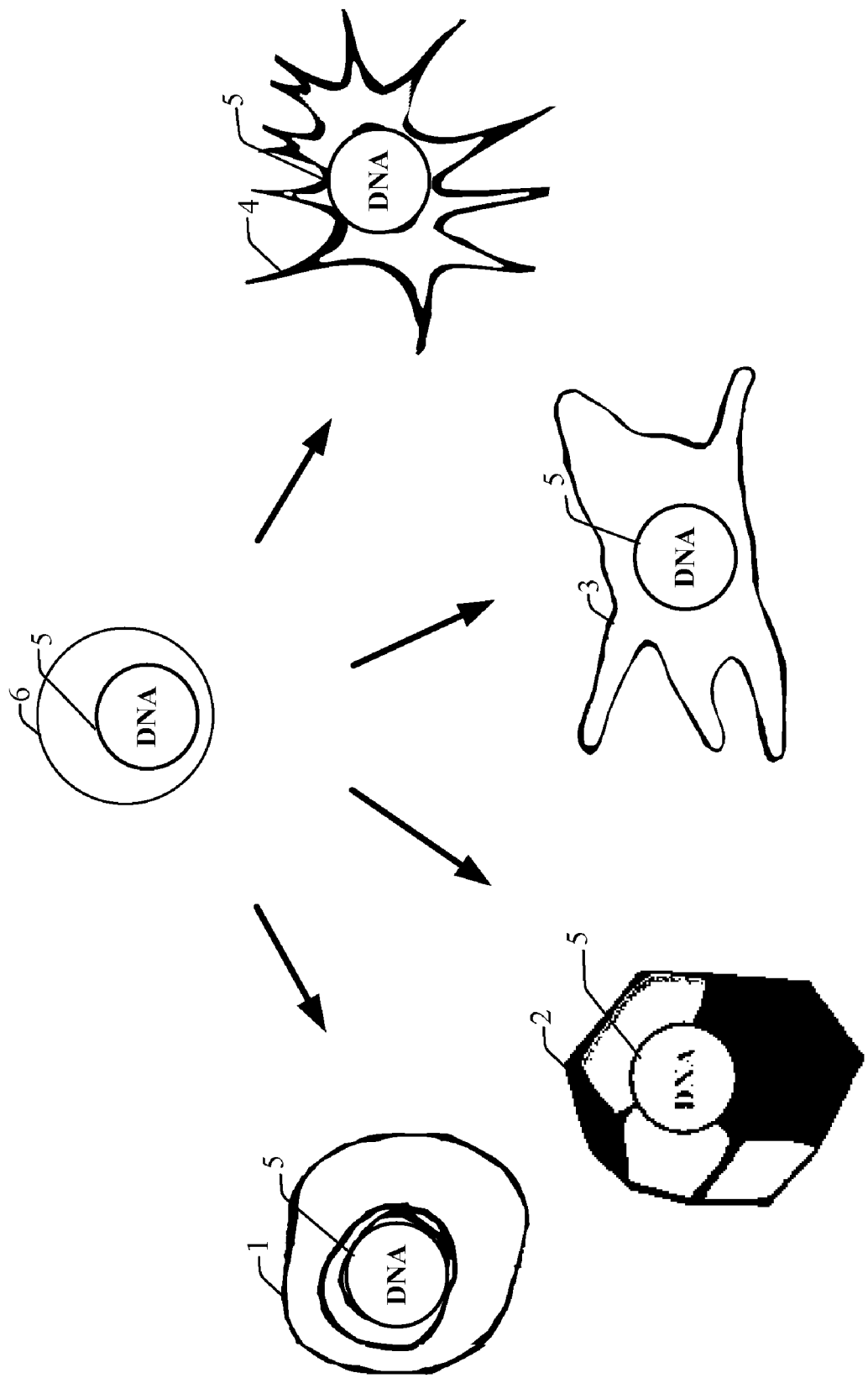
FIG. 1 is a simplified diagram illustrating a genomic differentiation enigma that the present invention addresses.

Reference is now made to FIG. 1 which is a simplified diagram providing a conceptual explanation of a genomic differentiation enigma, which the present invention addresses, inter alia.

FIG. 1 depicts various types of cells in an organism, such as a cartilage cell designated by reference numeral 1, a liver cell designated by reference numeral 2, a fibroblast cell designated by reference numeral 3, and a bone cell designated by reference numeral 4, all containing identical DNA designated by reference numeral 5. Notwithstanding that the various types of cells are all derived from an initial fertilized egg cell designated by reference numeral 6, each of these cells expresses different proteins and accordingly acquires a different shape and function.

The present invention proposes inter alia that the inevitable conclusion from the foregoing is, however, strikingly simple: The genome must contain a modular differentiation coding system. The genome of each cell must include multiple modules or records, possibly a different one for each cell type, as well as a mechanism causing each cell at its inception to be instructed which one of the multiple records governs its behavior.

This modular code concept may be somewhat difficult to grasp, since most persons are accustomed to view things from an external viewpoint. An architect, for example, looks at a plan of a building, which details exactly where each element (block, window, door, electrical switch, etc.) is to be placed relative to all other elements, and, using the plan, instructs builders to place these elements in their designated places. This is an example of an external viewpoint: The architect is external to the plan, which itself is external with respect to the physical building, and with respect to its various elements. The architect may therefore act as an "external organizing agent": seeing the full picture and the relationships between all elements, and being able to instruct from the outside where to place each of them.

According to a preferred embodiment of the present invention, genomic differentiation coding works differently, without any such external organizing agent. It comprises a smart block (the first cell), which is the architect and the plan, and which continuously duplicates itself, somehow knowing when to manifest itself as a block and when as a window, door, or electrical switch.

Reference is now made to FIGS. 2A-4 which are schematic diagrams which, when taken together, provide an analogy that illustrates a conceptual model of the present invention, addressing the genomic differentiation enigma.

Reference is now made to FIG. 2A. An imaginary talented chef, designated by reference numeral 7, is capable of preparing any meal provided that he is given specific written cooking instructions. This chef 7 is equipped with two items: (a) a thick recipe book, designated by reference numeral 8, and (b) a small note, designated by reference numeral 9, having a number scribbled on it. The recipe book 8 comprises multiple pages, each page detailing how to prepare a specific meal. The small note 9 indicates the page to be opened, and therefore the meal to be prepared. The chef looks at the page number written on the note, opens the recipe book to the appropriate page, and prepares the meal according to the written instructions on this page. In the example shown in FIG. 2A, the chef 7 is holding a small note 9 bearing the number 127. He therefore opens the book to page 127, as designated by reference numeral 10. Since this page contains the recipe for preparing bread, the chef 7 prepares a loaf of bread, designated by reference numeral 12. Pages of the book, such as page 10 in the example shown in FIG. 2A, contains additional information, designated by reference numeral 11 which additional data is further elaborated hereinbelow with reference to FIGS. 3 and 4.

Reference is now made to FIG. 2B, which depicts two identical chefs, a first chef, designated by reference numeral 13, and a second chef, designated by reference numeral 14, both holding an identical recipe book, designated by reference numeral 8. Although the first chef 13 and the second chef 14 are identical, and hold identical recipe books 8, they differ in that they hold different small notes: the first chef 13 holds a small note designated by reference numeral 9, having the number 127 written on it, whereas the second chef 14 holds a small note designated by reference numeral 15, having the number 134 written on it. Accordingly, the first chef 13 opens the book 8 to page 127, as designated by reference numeral 10 and, based on the instructions written on page 127 prepares a loaf of bread, designated by reference numeral 12. The second chef 14 opens the book 8 to page 134, as designated by reference numeral 16 and, based on the instructions written on page 134, prepares a pie, designated by reference numeral 17. Pages in the book, such as pages 10 and 16 in the examples shown in FIG. 2B, contain additional information, designated by reference numeral 11 which additional information is further elaborated hereinbelow with reference to FIGS. 3 and 4.

Figure 3:
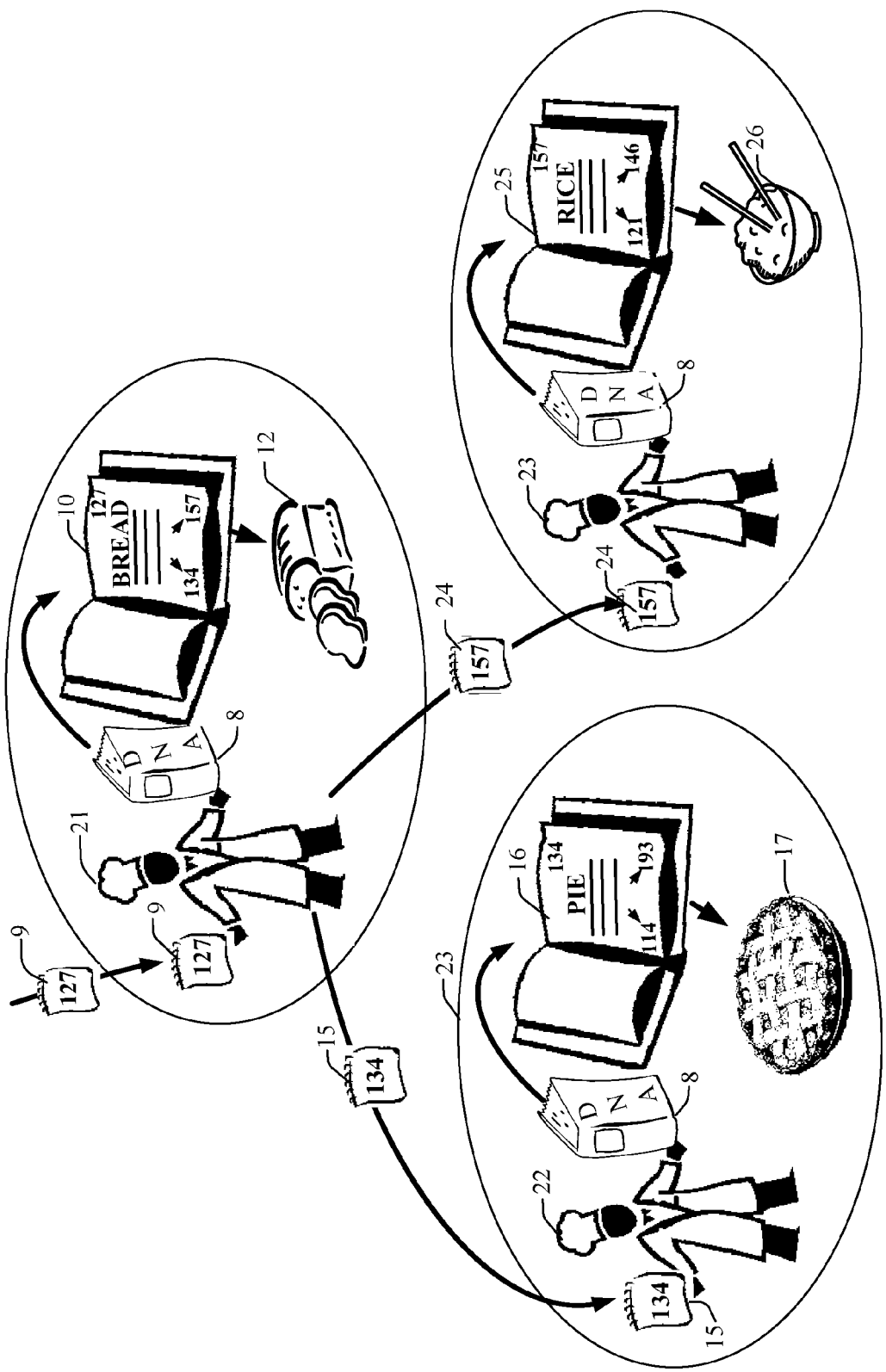

Reference is now made to FIG. 3 which illustrates a mode by which an imaginary chef can duplicate himself yielding two identical chefs, instructing each of the identical duplicate chefs to prepare a different meal. As an example, FIG. 3 shows chef 21 duplicating himself, yielding two duplicate chefs: a first duplicate chef designated by reference numeral 22 and a second duplicate chef designated by reference numeral 23. The duplicate chefs are identical to each other and to chef 21.

Like chefs 7 and 13 (FIGS. 2A and 2B), FIG. 3 shows chef 21 holding a recipe book 8 and receiving a note 9 bearing the number 127. The chef 21 therefore opens the book 8 to page 127, as designated by reference numeral 10, and prepares a loaf of bread 12. However, FIG. 3 also elaborates some of the additional information 11 (FIGS. 2A and 2B) found in page 10: the bottom of page 10, bears two numbers, 134 and 157.

Chef 21 is trained to perform the following three actions when he is finished preparing a meal: (a) Duplicate himself yielding two duplicate chefs, the first duplicate chef 22 and the second duplicate chef 23; (b) Duplicate his recipe book 8, handing an identical copy to each of the duplicate chefs 22 and 23; and (c) Write down the numbers found at the bottom of the page he was instructed to open the book to. In the example of chef 21, since he was instructed to open the book to page 10, he writes the numbers 134 and 157 on two respective notes designated by reference numerals 15 and 24, and hands note 15 bearing the number 134 to the first duplicate chef 22 and note 24 bearing the number 157 to the second duplicate chef 23.

Accordingly, the first duplicate chef 22 receives note 15 bearing the number 134 and therefore opens the recipe book 8 to page 134, as designated by reference numeral 16, and prepares a pie, designated by reference numeral 17. The second duplicate chef 23 receives note 24 bearing the number 157 and therefore opens the recipe book 8 to page 157, as designated by reference numeral 25, and prepares rice, designated by reference numeral 26.

It is appreciated that while chef 21 and duplicate chefs 22 and 23 are identical and hold identical recipe books 8, they each prepare a different meal. It is also appreciated that the meals prepared by the first duplicate chef 22 and the second duplicate chef 23 are determined by chef 21, and are mediated by the differently numbered notes 15 and 24 passed on from chef 21 to duplicate chefs 22 and 23 respectively.

It is further appreciated that the mechanism illustrated by FIG. 3 enables an unlimited lineage of chefs to divide into duplicate, identical chefs and to determine the meals those duplicate chefs would prepare. As an example, since the first duplicate chef 22 is directed to page 134, as designated by reference numeral 16, when he duplicates himself (not shown), he will instruct his two duplicate chefs to prepare meals specified on pages the numbers of which are written at the bottom of page 134, i.e. pages 114 and 193 respectively. Similarly, the second duplicate chef 23 will instruct its duplicate chefs to prepare meals specified on pages 121 and 146 respectively, etc.

Figure 4:
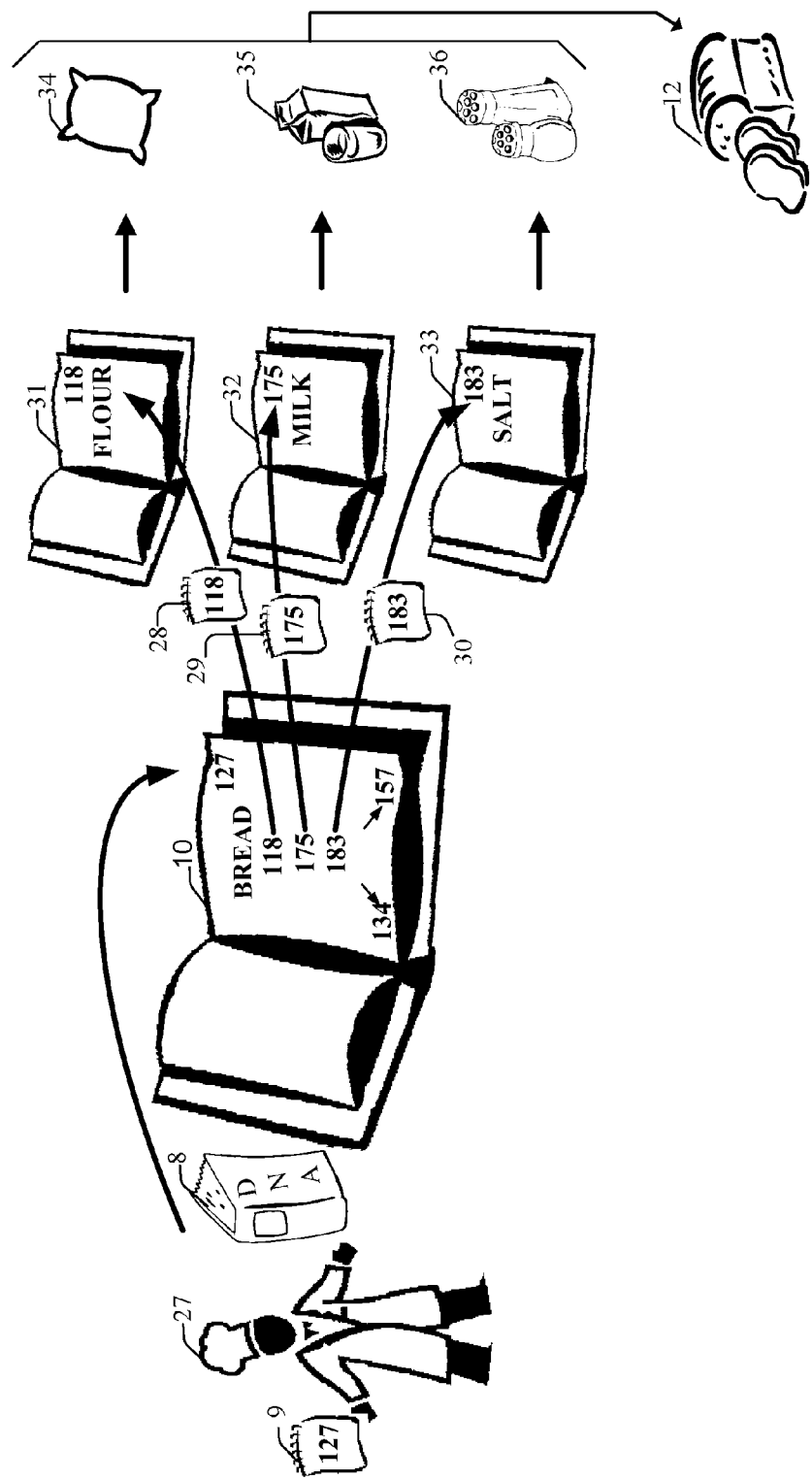

Reference is now made to FIG. 4, which illustrates a mode by which a chef can prepare a meal based on instructions written in a shorthand format: The main meal-page to which a chef is directed by a small note he is given, merely contains a list of numbers which further direct him to other pages, each specifying how to prepare an ingredient of that meal.

To illustrate this shorthand format FIG. 4 shows a chef, designated by reference numeral 27, holding the recipe book 8 and the note 9 which bears the number 127. The chef 27 accordingly opens the recipe book 8 to page 127, as designated by reference numeral 10, and based on instructions on this page prepares bread 12. This is similar to chefs 7, 13 and 21 of FIGS. 2A, 2B and 3 respectively.

However, FIG. 4 also further elaborates some of the additional information 11 (FIGS. 2A and 2B) found in page 10. FIG. 4 shows the cooking "instructions" found on page 10 for making bread 12 written in a shorthand format, comprising only three numbers, 118, 175 and 183. The chef 27 writes these numbers on three respective notes designated by reference numerals 28-30. The notes 28-30 are then used to turn to corresponding pages 31-33 of the book 8, which pages provide instructions for preparation of ingredients required for making bread 12: flour 34, milk 35 and salt 36.

The analogy provided by FIGS. 2A-4 illustrates the conceptual model of the present invention addressing the genomic differentiation enigma, and may be explained as follows: The chefs and duplicate chefs 7, 13, 14, 21-23 and 27

(FIGS. 2A-4) in the given analogy represents cells. The thick recipe book 8 represents the DNA 5 (FIG. 1). Preparing meals such as bread 12, pie 17 or rice 16 (all of FIG. 3) represent the cell manifesting itself as a specific cell-type, such as cartilage cell 1, liver cell 2, fibroblast cell 3, and bone cell 4 (all of FIG. 1). Ingredients of a meal, such as flour 34, milk 35 and salt 36 (all of FIG. 4), represent proteins typically expressed by a cell of a certain cell-type, such as 1-4. Like the different chefs of the analogy, having the same thick recipe book 8 yet preparing different meals, so do different cells in an organism contain the same DNA 5 yet manifest themselves as different cell types, such as 1-4, expressing proteins typical of these respective cell types. Application of analogy of FIGS. 2A-4 to cell-biology is further described hereinbelow with reference to FIGS. 5A-7.

Figure 5A:
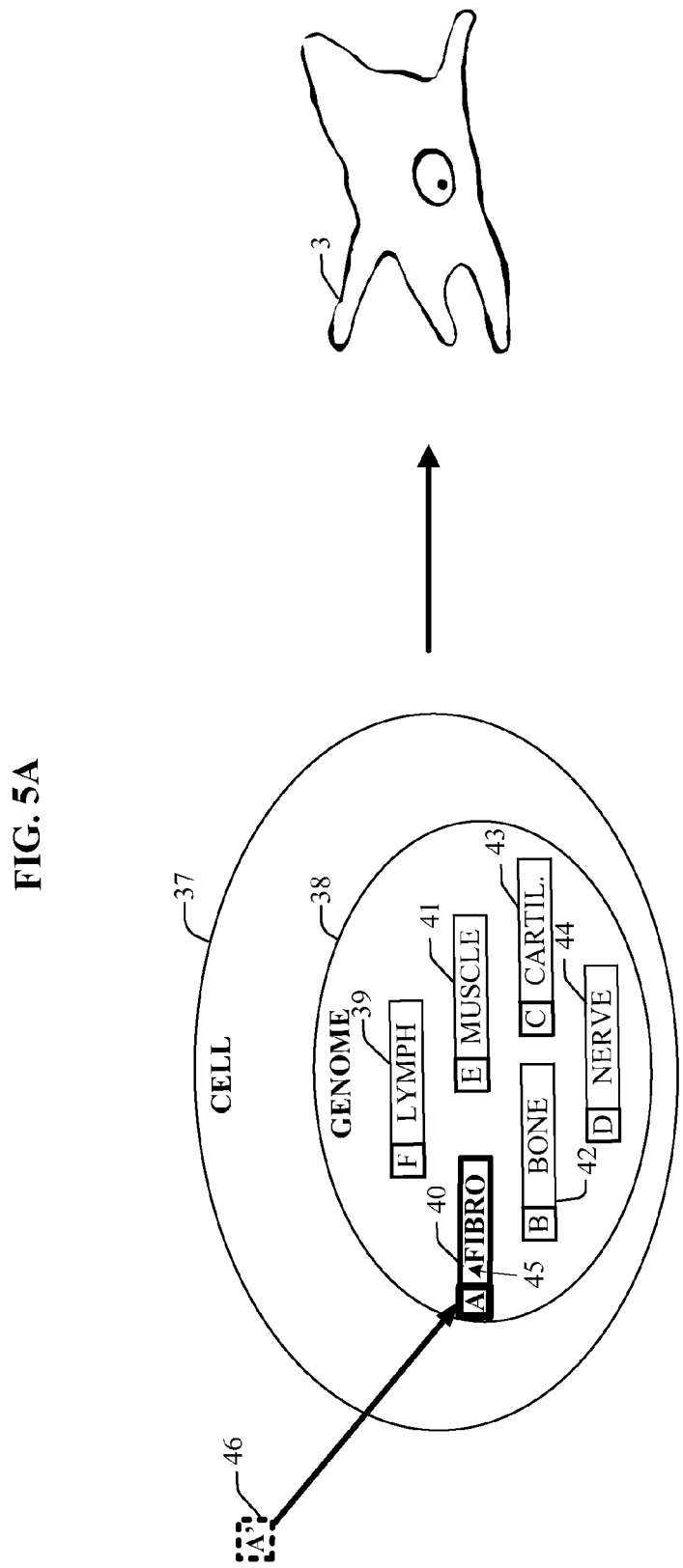

Reference is now made to FIGS. 5A and 5B which are schematic diagrams, which when taken together illustrate a Genomic Records concept of the present invention, addressing the genomic differentiation enigma. FIGS. 5A and 5B correspond to FIGS. 2A and 2B of the chef analogy described hereinabove.

An important aspect of the present invention is the Genomic Records concept. According to a preferred embodiment of the present invention the DNA (the thick recipe book 8 in the illustration) comprises a very large number of Genomic Records (analogous to pages, such as 10, 16 and 25, in the recipe book) containing the instructions for differentiation of a different cell-type, or developmental process. Each Genomic Record comprises by a very short genomic sequence which functions as a "Genomic Address" of that Genomic Record (analogous to a page number, such as the numbers 127, 134 and 157 appearing in FIG. 3, in the recipe book). At its inception, in addition to the DNA, each cell also receives a short RNA segment (the scribbled short note, such as 9, 15, 24 of FIG. 3 in the illustration). This short RNA segment binds complementarily to a "Genomic Address" sequence of one of the Genomic Records, thereby modulating expression of that Genomic Record, and accordingly determining the cell's-fate (analogous to opening the recipe book 8 to a page corresponding to a number on the scribbled note, thereby determining the meal to be prepared). A Genomic Record may also comprise multiple short RNA segments each of which binds complementarily to a target protein coding gene, thus modulating expression of this target gene (analogous to the shorthand format whereby a page, such as 10, points to other pages, such as 31-33, encoding various ingredient, such as 34, 35 and 36, all of FIG. 4).

Reference is now made to FIG. 5A. FIG. 5A illustrates a cell 37, having a genome 38. The genome 38 comprises a plurality of Genomic Records, some of which Genomic Records correlate to specific cell-types. As an example, 6 such genomic records are shown, corresponding to 6 cell-types: LYMPH genomic record 39, FIBROBLAST genomic record 40, MUSCLE genomic record 41, BONE genomic record 42, CARTILAGE genomic record 43 and NERVE genomic record 44. Each genomic record comprises genomic instructions on differentiation into a specific cell-type, as further elaborated hereinbelow with reference to FIG. 7. At cell inception, the cell 37 receives a maternal short RNA segment 46, which activates one of the genomic records, causing the cell to differentiate according to the instructions this genomic record comprises. As an example FIG. 5A illustrates reception of a maternal short RNA segment designated 46 having a nucleotide sequence herein symbolically represented by A'.

The FIBROBLAST genomic record 40 contains a binding site having a nucleotide sequence symbolically represented by A, which is complementary to the nucleotide sequence of A', and therefore the short RNA segment 46 binds to the FIBROBLAST genomic record 40. This binding activates the FIBROBLAST genomic record, causing the cell 37 to differentiate into a fibroblast cell-type 3 (FIG. 1). Other genomic records, designated by reference numerals 39 and 41-44, comprise binding sites having nucleotide sequences that are symbolically represented by F, E, B, C and D, which are not complementary of the nucleotide sequence of the short RNA segment 46, and are therefore not activated thereby. Genomic Records, such as the FIBROBLAST genomic record 40 contain additional information, designated by reference numeral 45, which is further elaborated hereinbelow with reference to FIGS. 6 and 7.

Reference is now made to FIG. 5B, which is a simplified schematic diagram, illustrating cellular differentiation mediated by the "Genomic Records" concept. FIG. 5B depicts 2 cells in an organism, CELL A designated by reference numeral 47 and CELL B designated by reference numeral 48, each having a genome 38. It is appreciated that since CELL A 47 and CELL B 48 are cells in the same organism, the genome 38 of cells 47 and 48 is identical. Despite having an identical genome 38, CELL A 47 differentiates differently from CELL B 48, due to activation of different genomic records in these two cells. In CELL A 47 the FIBRO GENOMIC RECORD 40 is activated, causing CELL A 47 to differentiate into a FIBROBLAST CELL 3, whereas in CELL B 48 the BONE GENOMIC RECORD 42 is activated, causing the CELL B 48 to differentiate into a BONE CELL 4 (FIG. 1). The cause for activation of different genomic records in these two cells is the different maternal short RNA which they both received: CELL A 47 received a maternal short RNA segment designated 46 bearing a nucleotide sequence represented by A' activating genomic record FIBRO 40, whereas CELL B 48 received a maternal short RNA segment designated 49 bearing a nucleotide sequence represented by B' activating genomic record BONE 42.

Figure 6:
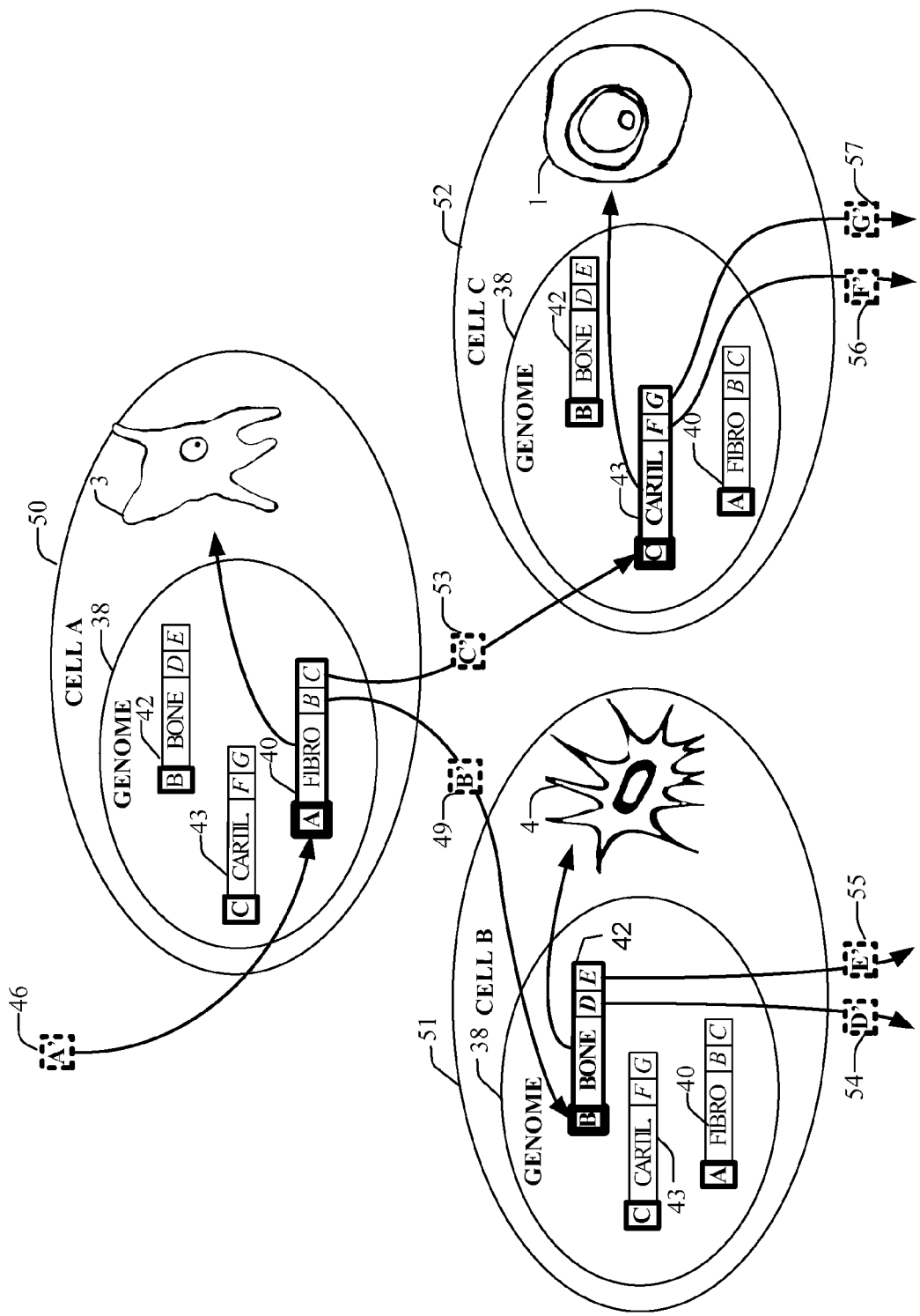
FIG. 6 is a schematic diagram illustrating a 'genomically programmed cell differentiation' concept of the conceptual model of the present invention, addressing the genomic differentiation enigma.

Reference is now made to FIG. 6 which is a schematic diagram illustrating a "genomically programmed cell differentiation" concept of the conceptual model of the present invention, addressing the genomic differentiation enigma.

A cell designated CELL A 50 divides into 2 cells designated CELL B 51 and CELL C 52. CELL A 50, CELL B 51 and CELL C 52 each comprise a GENOME 38, which GENOME 38 comprises a plurality of GENOMIC RECORDS, herein exemplified by reference numerals 40, 42 and 43. It is appreciated that since CELL A 50, CELL B 51 and CELL C 52 are cells in the same organism, the GENOME 38 of these cells, and the GENOMIC RECORDS, exemplified by 40, 42 and 43, the genome of these cells comprises, are identical in these cells.

As described above with reference to FIG. 5B, at its inception, CELL A 50 receives a maternal short RNA segment, designated by reference numeral 46, having a nucleotide sequence represented by A' and outlined by a broken line, which activates the FIBRO genomic record 40, thereby causing CELL A 50 to differentiate into a FIBROBLAST CELL 3. However, FIG. 6 elaborates some of the additional information 45 (FIG. 5A) of the genomic records: Genomic record may also comprise two short genomic sequences, referred to here as Daughter Cell Genomic Addresses. Blocks designated B and C are Daughter Cell Genomic Addresses of the FIBRO Genomic Record. At cell division, each parent cell transcribes two short RNA segments, corresponding to the two Daughter Cell Genomic Addresses of the Genomic Record of that parent cell, and transfers one to each of its two daughter cells. CELL A 50 transcribes and transfers to its two daughter cells 51 and 52, two short RNA segments, designated by reference numerals 49 and 53, outlined by a broken line and designated B' and C', corresponding to daughter cell genomic addresses designated B and C comprised in the FIBRO genomic record 40.

CELL B 51 therefore receives the above mentioned maternal short RNA segment designated 49 having a nucleotide sequence represented by B', which binds complementarily to genomic address designated B of the BONE genomic record 42, thereby activating this genomic record, which in turn causes CELL B 51 to differentiate into a BONE CELL 4. Similarly, CELL C 52 receives the above mentioned maternal short RNA segment designated 53 having a nucleotide sequence represented by C', which binds complementarily to genomic address designated C of a CARTILAGE genomic record 43, thereby activating this genomic record, which in turn causes CELL C 52 to differentiate into a CARTILAGE CELL 1 (FIG. 1).

It is appreciated that the mechanism illustrated by FIG. 6 enables an unlimited lineage of cells to divide into daughter cells containing the same DNA 5 (FIG. 1), and to determine the cell-fate of these daughter cells. For example, when CELL B 51 and CELL C 52 divide into their respective daughter cells (not shown), they will transfer short RNA segments designated by reference numerals 54-57, to their respective daughter cells. The cell fate of each of these daughter cells is effected by the identity of the maternal short RNA segments 54-57 they each receive, which in turn determine the genomic record activated.

Figure 7:
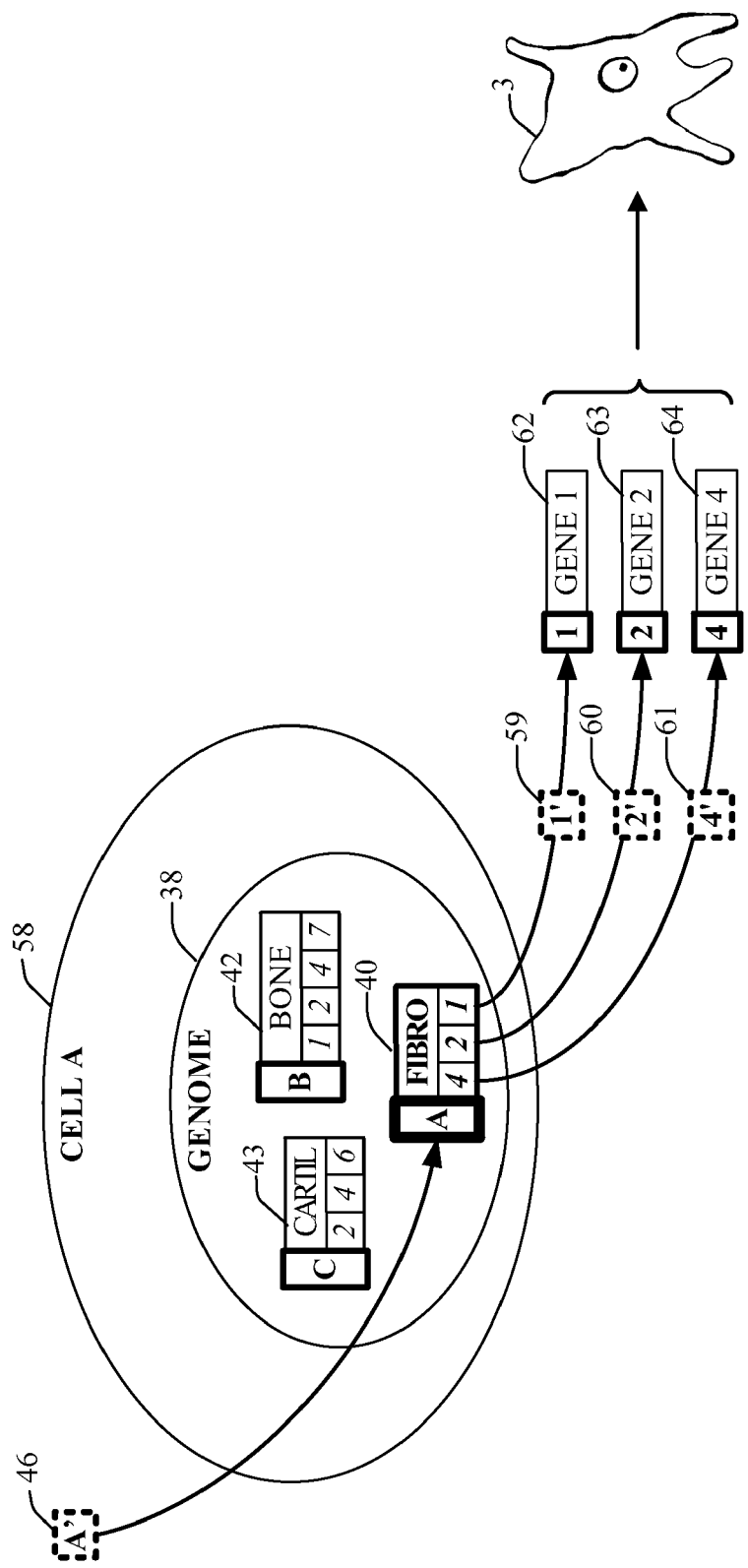
FIG. 7 is a schematic diagram illustrating a 'genomically programmed cell-specific protein expression modulation' concept of the conceptual model of the present invention, addressing the genomic differentiation enigma.

Reference is now made to FIG. 7 which is a schematic diagram illustrating a "genomically programmed cell-specific protein expression modulation" concept of the conceptual model of the present invention, addressing the genomic differentiation enigma.

Cell A 58 receives a maternal short RNA segment designated 46 having a nucleotide sequence represented by A' which activates the FIBROBLAST genomic record 40, by complementarily binding to a binding site this genomic record comprises, the nucleotide sequence of which binding site is designated A. This is similar to the process shown in FIG. 5A. However, FIG. 7 further elaborates some of the additional information 45 (FIG. 1). The FIBROBLAST genomic record 40 comprises 3 short nucleotide segments, having nucleotide sequences symbolically represented by 1, 2 and 4 respectively, which encode 3 respective short RNA oligonucleotides, designated by reference numerals 59-61. Each of these short RNA oligonucleotides modulates expression of a respective one of the target genes GENE 1, GENE 2 and GENE 4, designated by reference numerals 62-64 respectively, by complementarily binding to a binding site sequence associated with that target gene. In a preferred embodiment of the present invention, the modulation of expression of target genes such as 62-64 comprises translation inhibition of target genes by complementarily binding to binding sites located in untranslated regions of the target genes. Modulation of expression of these genes results in CELL A 58 differentiating into a FIBROBLAST cell-type 3 (FIG. 1).

It is appreciated that the concept of genomic records each comprising a cluster of short RNA segments, which segments modulate expression of target genes thereby modulating differentiation, is compatible with the clusters of miRNA oligonucleotides of the present invention, and their translational inhibition of respective target genes by means of complementarily binding to binding sites located in the untranslated regions of mRNA of these target genes.

Figure 8:
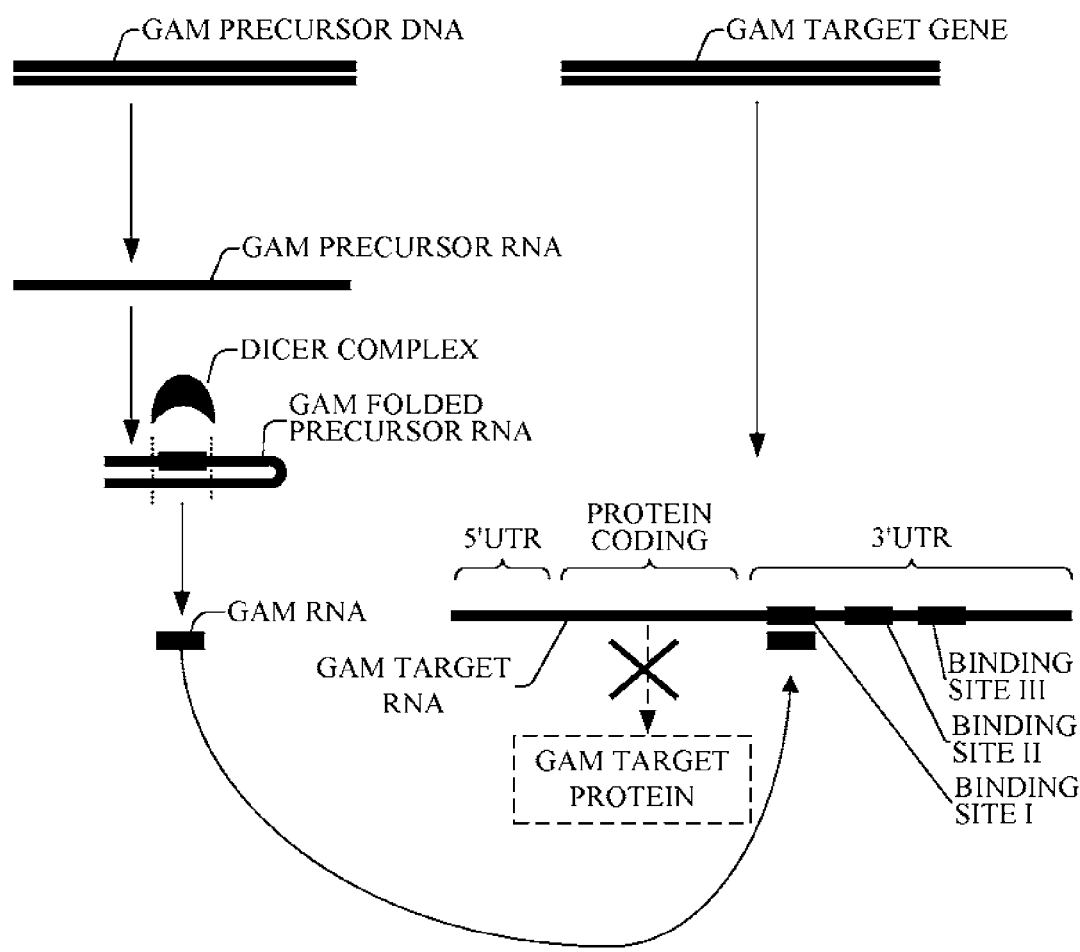
FIG. 8 is a simplified diagram illustrating a mode by which an oligonucleotide of a novel group of oligonucleotides of the present invention, modulates expression of known target genes.

Reference is now made to FIG. 8, which is a simplified diagram describing how a plurality of novel bioinformatically detectable oligonucleotides of the present invention, referred to here as Genomic Address Messenger (GAM) oligonucleotides, modulate expression of respective target genes.

GAM oligonucleotides are novel, bioinformatically detectable, regulatory, non protein coding, micro RNA (miRNA)-like oligonucleotides. The method by which GAMs are detected is described hereinbelow with additional reference to FIGS. 9-15.

GAM PRECURSOR DNA is encoded by the human genome. GAM TARGET GENE is a human gene encoded by the human genome.

GAM PRECURSOR DNA encodes a GAM PRECURSOR RNA. Similar to miRNA oligonucleotides, GAM PRECURSOR RNA does not encode a protein. GAM PRECURSOR RNA folds onto itself, forming GAM FOLDED PRECURSOR RNA, which has a two-dimensional 'hairpin structure'. As is well known in the art, this 'hairpin structure', is typical of by miRNA precursor oligonucleotides, and is due to the fact that the nucleotide sequence of the first half of the miRNA precursor oligonucleotide is a fully or partially complementary sequence of the nucleotide sequence of the second half thereof. By complementary is meant a sequence which is reversed and wherein each nucleotide is replaced by a complementary nucleotide, as is well known in the art (e.g. ATGGC is the complementary sequence of GCCAT).

An enzyme complex comprising an enzyme called Dicer together with other necessary proteins, herein designated as the DICER COMPLEX, 'dices' the GAM FOLDED PRECURSOR RNA yielding a GAM RNA, in the form of a single stranded ~22 nt long RNA segment. The DICER COMPLEX is known in the art to dice a hairpin structured miRNA precursor, thereby yielding diced miRNA in the form of a short ~22 nt RNA segment.

GAM TARGET GENE encodes a corresponding messenger RNA, designated GAM TARGET RNA. GAM TARGET RNA comprises three regions, as is typical of mRNA of a protein coding gene: a 5' untranslated region, a protein coding region and a 3' untranslated region, designated 5'UTR, PROTEIN CODING and 3'UTR respectively.

GAM RNA binds complementarily (i.e. hybridizes) to one or more target binding sites located in untranslated regions of GAM TARGET RNA. This complementary binding is due to the fact that the nucleotide sequence of GAM RNA is a partial or fully complementary sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is only illustrative and that any suitable number of target binding sites may be present. It is further appreciated that although FIG. 8 shows target binding sites only in the 3'UTR region, these target binding sites may be located instead in the 5'UTR region or in both 3'UTR and 5'UTR regions.

The complementary binding of GAM RNA to target binding sites on GAM TARGET RNA, such as BINDING SITE I, BINDING SITE II and BINDING SITE III, inhibits translation of GAM TARGET RNA into GAM TARGET PROTEIN, which is shown surrounded by a broken line.

It is appreciated that GAM TARGET GENE in fact represents a plurality of GAM target genes. The mRNA of each one of this plurality of GAM target genes comprises one or more target binding sites, each having a nucleotide sequence which is at least partly complementary to GAM RNA, and which when bound by GAM RNA causes inhibition of translation of the GAM target mRNA into a corresponding GAM target protein.

The mechanism of the translational inhibition exerted by GAM RNA on one or more GAM TARGET GENE, may be similar or identical to the known mechanism of translational inhibition exerted by known miRNA oligonucleotides.

The nucleotide sequence of the predicted human GAM RNA (miRNA) GAM1032, which is described by FIG. 8, and its respective genomic source and genomic location are set forth in Tables 1-3. Table 1 describes the predicted human GAM RNA (miRNA) as set forth in SEQ ID NO: 15.

TABLE 1

| GAM SEQ-ID | GAM NAME | GAM RNA SEQUENCE | GAM POS |
|---|---|---|---|
| 15 | GAM1032 | CTAGACTGAAGCTCCTTGAGGA | A |

Table 2 describes the GAM PRECURSOR RNA (hairpin) as set forth in SEQ ID NO: 6527 and how it relates to FIG. 8.

TABLE 2

| GAM NAME | PRECUR SEQ-ID | PRECURSOR SEQUENCE | GAM DESCRIPTION |
|---|---|---|---|
| GAM1032 | 6527 | GCTAGTCACT GGGGCAAAGA TGACTAAAAC ACTTTTCCTG CCCTCGAGGA GCTCACAGTC TAGTATGTCT CATCCCCTAC TAGACTGAAG CTCCTTGAGG ACAGGGATGG TCATACTCAC CTCGGTGTTG C | FIG. 8 further provides a conceptual description of another novel bioinformatically detected oligonucleotides of the present invention, referred to here as Genomic Address Messenger 1032 (GAM1032) oligonucleotides modulates expression of respective target genes whose function and utility is known in the art GAM1032 is a novel bioinformatically detectable regulatory, non protein coding, micro RNA (miRNA)-like oligonucleotide. The method by which GAM1032 was detected is described with additional reference to FIGS. 9-15 GAM PRECURSOR DNA is encoded by the human genome. GAM TARGET GENE is a humen gene encoded by the human genome GAM1032 precursor DNA, herein designated GAM PRECURSOR DNA, encodes a GAM1032 precursor RNA, herein designated GAM PRECURSOR RNA. Similar to other miRNA genes GAM1032 precursor RNA does not encode a protein. A nucleotide sequence identical or highly similar to the nucleotide sequence of GAM1032 precursor RNA is designated SEQ ID: 6527, and is provided hereinbelow with reference to the sequence listing part. Nucleotide sequence SEQ ID: 6527 is located from position 141427052 to position 141427182 relative to chromosome 8 on the '-' strand. GAM1032 precursor RNA folds onto itself, forming GAM1032 folded precursor RNA, herein designated GAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a |

TABLE 2-continued

| GAM NAME | PRECUR SEQ-ID | PRECURSOR SEQUENCE | GAM DESCRIPTION |
|---|---|---|---|
| | | | miRNA gene is a fully or partially complementary sequence of the nucleotide sequence of the second half thereof. Nucleotide sequence of GAM1032 precursor RNA, designated SEQ ID NO: 6527, and a schematic representation of a predicted secondary folding of GAM1032 folded precursor RNA, herein designated GAM FOLDED PRECURSOR RNA, are set forth in Tables 3 and 4 incorporated herein An enzyme complex designated DICER COMPLEX, 'dices' the GAM1032 folded precursor RNA yielding a GAM1032 RNA, herein designated GAM RNA, in the form of a single stranded ~22nt long RNA segment. As is known in the art, 'dicing' of a hairpin structured RNA precursor product to yield a short ~22nt RNA segment is catalyzed by an enzyme complex comprising an enzyme called Dicer RNase III together with other necessary proteins. Table 5 provides a nucleotide sequence that is highly likely to be identical or highly similar to the nucleotide sequence of GAM1032 RNA, hereby incorporated herein. Expression of GAM1032 RNA was experimentally validated in HeLa cells using the methods described with reference to FIGS.22 to 24 GAM1032 target gene, herein designated GAM TARGET GENE, encodes a corresponding messenger RNA, GAM1032 target RNA, herein designated GAM TARGET RNA.GAM1032 target RNA comprises three regions, as is typical of mRNA of a protein coding gene: a 5' untranslated region, a protein coding region and a 3'untranslated region, designated 5'UTR, PROTEIN CODING and 3'UTR respectively GAM1032 RNA, herein designated GAM RNA, binds complementarily to one or more target binding sites located in untranslated regions of GAM1032 target RNA, herein designated GAM TARGET RNA. This complementary binding is due to the fact that the nucleotide sequence of GAM1032 RNA is a partial or fully complementary sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is only illustrative and that any suitable number of target binding sites may be present. It is further appreciated that although FIG. 8 shows target binding sites only in the 3'UTR region,these target binding sites may be located instead in the 5'UTR region or in both 3'UTR and 5'UTR region The complementary binding of GAM1032 RNA, herein designated GAM RNA, to target binding sites on GAM1032 target RNA, herein designated GAM TARGET RNA, such as BINDING SITE I, |

TABLE 2-continued

| PRECUR GAM NAME SEQ-ID | PRECURSOR SEQUENCE | GAM DESCRIPTION |
|---|---|---|
| | | BINDING SITE II and BINDING SITE III, inhibits translation of GAM1032 target RNA into GAM1032 target protein, herein designated GAM TARGET PROTEIN, which is shown surrounded by a broken line It is appreciated that GAM1032 target gene, herein designated GAM TARGET GENE, in fact represents a plurality of GAM1032 target genes. The mRNA of each one of this plurality of GAM1032 target genes comprises one or more target binding sites, each having a nucleotide sequence which is at least partly complementary to GAM1032 RNA, herein designated GAM RNA, and which when bound by GAM1032 RNA causes inhibition of translation of the GAM1032 target mRNA into a corresponding GAM1032 target protein. The mechanism of the translational inhibition exerted by GAM1032 RNA, herein designated GAM RNA, on one or more GAM1032 target genes, herein collectively designated GAM TARGET GENE, may be similar or identical to the known mechanism of translational inhibition exerted byknown miRNA genes Nucleotide sequence of GAM1032 precursor RNA, herein designated GAM PRECURSOR RNA, respective genomic sources and chromosomal locations and a schematic representation of a predicted secondary folding of GAM1032 folded precursor RNA, herein designated GAM FOLDED PRECURSOR RNA, are set forth in Tables 3 and 4, incorporated herein. Nucleotide sequences of a 'diced' GAM1032 RNA, herein designated GAM RNA, of GAM1032 folded precursor RNA, herein designated GAM FOLDED PRECURSOR RNA, are set forth in Table 5, incorporated herein Nucleotide sequences of target binding sites, such as BINDING SITE-I, BINDING SITE-II and BINDING SITE-III of FIG. 8, found on GAM1032 target RNA, herein designated GAM TARGET RNA, and a schematic representation of the complementarity of each of these target binding sites to GAM1032 RNA, herein designated GAM RNA, are set forth in Tables 6 and 7, incorporated herein.It is appreciated that specific functions, and accordingly utilities, of GAM1032 RNA correlate with, and may be deduced from, the identity of the GAM1032 target gene inhibited thereby, whose functions are set forth in Table 8, incorporated herein. |

Table 3 shows data relating to the source and location of the GAM oligonucleotide, specifically the GAM PRECURSOR (hairpin) and its position in the human genome.

TABLE 3

| GAM NAME GAM | PRE-CUR SEQ-ID | ORGAN-ISM | CHR | STR AND | CHR-START OFFSET | CHR-END OFFSET | SOURCE REF-ID |
|---|---|---|---|---|---|---|---|
| 1032 | 6527 | hsa | 8 | − | 141427052 | 141427182 | |

Table 4 shows a schematic representation of the GAM folded precursor as set forth in SEQ ID NO: 6527, beginning at the 5' end (beginning of upper row) to the 3' end (beginning of lower row), where the hairpin loop is positioned at the right part of the schematic.

TABLE 4

| GAM NAME | PRE-CUR SEQ-ID | PRECURSOR-SEQUENCE | GAM FOLDED PRECURSOR RNA |
|---|---|---|---|
| GAM 1032 | 6527 | GCTAGTCACT GGGGCAAAGA TGACTAAAAC ACTTTTCCTG CCCTCGAGGA GCTCACAGTC TAGTATGTCT CATCCCCTAC TAGACTGAAG CTCCTTGAGG ACAGGGATGG TCATACTCAC CTCGGTGTTG C | TACT    CAAAG    AAACACTT  C    CA<br>TGT GC  CACTGGGG  ATGACTA    TTCCTG CCTCGAGGAGCT<br>CAGTCTAGTA CG  GTGGCTCC  TACTGGT    AGGGAC GGAGTTCCTCGA<br>GTCAGATCAT  TT--    ACTCA    --------    A<br>A-    -- CTCATCCCC  --------- |

Table 5 shows the mature GAM RNA as set forth in SEQ ID NO: 15 as sliced by DICER from the GAM PRECURSOR sequence (hairpin) as set forth in SEQ ID NO: 6527.

TABLE 5

| GAM NAME | GAM RNA SEQUENCE | PRECUR SEQ-ID | SOURCE REF-ID | GAM POS |
|---|---|---|---|---|
| GAM1032 | CTAGACTGAAGCTCCTTGAGGA | 6527 | | A |

Table 6 shows data relating to the SEQ ID NO of the GAM target binding site sequence of the target gene name as bound by the GAM RNA as set forth in SEQ ID NO: 15.

TABLE 6

| TARGET BINDING SITE SEQ-ID | TARGET | TARGET BINDING SITE SEQUENCE |
|---|---|---|
| 3504 | CHAT | TGCTCCTGCCACTAGGTTTCA |
| 3505 | CHAT | TGGGGAAGTGCGGTGACTGGGAAATGC |
| 3506 | CHAT | CCAGCGCACAGCCTGGGCAG |
| 3507 | CHAT | CATCCCTGCACCAGGACTCACCAAGA |
| 3508 | CHAT | CAAGACGCCCATCCTGGAAAAGGTCCC |
| 3509 | CHAT | AGGCAGCAGAGCCGAGGAGAGCAGGT |
| 3510 | CHAT | CGCGTCAGGCCCAGCGCACAGCCTG |
| 3511 | CHAT | GCACAGCCTGGGCAGCTCAGCCTG |
| 3512 | CHAT | GAGCTAGGGGCAGGAGGCATG |
| 3513 | CHAT | GAGAAAGGAGTAGGAGCCTAGCA |
| 3514 | CHAT | GCCTCAAGGGGTGCGGCCCTCTCAG |
| 3515 | CHAT | GCGTCAGGCCCAGCGCACAGCCTG |
| 3516 | CHAT | GCTCAGCCTGTCAGCTGAGCACGGGCG |
| 3517 | CHAT | GCTTTGAGAAAGGAGTAG |
| 3518 | CHAT | GGTGACTGGGAAATGCTGAG |
| 3519 | CHAT | GTCCGACCTCTGGAAATGT |
| 3520 | CHAT | GGCTCACACCCCCGCCCACAC |
| 3651 | CTSK | GCACCCTAGAGGACTAGGGTA |
| 3652 | CTSK | CTTCCACGATGGTGCAGTG |
| 3653 | CTSK | CTTCCTACTTTGCTTCTCTCCA |
| 3654 | CTSK | CTTCCCTTCTTTGCAC |
| 3655 | CTSK | CTGACTTCTCACTTCCTAAG |
| 3656 | CTSK | CCTACTTTGCTTCTCTCCA |
| 3657 | CTSK | CCTTCCTACTTTGCTTCTCTC |
| 3658 | CTSK | GTCTATGTTTTCTACTCCAA |
| 3659 | CTSK | GTACAGGTACAGGCTGGAGATT |
| 3660 | CTSK | CAGTGTAACGATGCACTTTGG |
| 3661 | CTSK | AATAAATCTAGCACCCCTGAT |

TABLE 6-continued

| TARGET BINDING SITE SEQ-ID | TARGET | TARGET BINDING SITE SEQUENCE |
|---|---|---|
| 3662 | CTSK | TCTATTCATAAGTCTTTGGTACAAG |
| 3663 | CTSK | TCCTGCTCTTCCATTTCTTCC |
| 3664 | CTSK | TCCTACTTTGCTTCTCTCCA |
| 3665 | CTSK | TCCTCAAGGTAGAAATGTCTAT |
| 3666 | CTSK | TCCATCCTGCTCTTCCATTTCTTCCA |
| 3667 | CTSK | TGACTTCTCACTTCCTAAG |
| 3668 | CTSK | TCTTCCACGATGGTGCAGTG |
| 3669 | CTSK | TTGAAGCAGATGTGGTGA |
| 3670 | CTSK | TTGTCCCAGGGCTGATGCTGT |
| 3671 | CTSK | TTTCCAGCCGATCACTGGAGCT |
| 4796 | MPO | TTTATCCATAGACAGGGCCC |
| 4797 | MPO | TATTGAGCACCTACTACATGCA |
| 4798 | MPO | TCCTTGCCCTAGATGAGCCCAGC |
| 4799 | MPO | TCCTCACCCTGATTTCTTGCTT |
| 4800 | MPO | TCAGGTGAGCTGTGGAGGTGGGGTC |
| 4801 | MPO | GGAGAAGAGAGATGGGGGTTCC |
| 4802 | MPO | GGAGCACAGCTCAGGAACTAGA |
| 4803 | MPO | GGAGGTGGGGTCCTTGGAAGC |
| 4804 | MPO | GCTCCCCTTTTTCTTCCTCA |
| 4805 | MPO | GCTCAGGAACTAGACTGCCTG |
| 4806 | MPO | GCTGGGCTGTGTGGTTGACTT |
| 4807 | MPO | GCCCAGCCCTGTTCTGGGTGCAG |
| 4808 | MPO | GGGCCTGTTGCCCTTTCTGTACCA |
| 4809 | MPO | GGGAAGCCTCCTAAGGCCAGG |
| 4810 | MPO | GGCCAGGTAAGGGGGTGCAGCAGTGAG |
| 4811 | MPO | GGCTCCCCTTTTTCTTCCTCACCCT |
| 4812 | MPO | GGTGAGCTGTGGAGGTGGGG |
| 4813 | MPO | GAGCAAATTACCCTCCTTAAACAAGAG |
| 4814 | MPO | CTTGTAAATTACATCTGTCATGGTTT |
| 4815 | MPO | CCTCAAGGAGGTCTGG |
| 4816 | MPO | CCTCTGGTTCTTCATTTATTGAG |
| 4817 | MPO | CTGAGTATGTGGAAGGCAGCA |
| 4818 | MPO | CTGAGTATGTGGAAGGCAGCAGAGCGGA |
| 4819 | MPO | AGGGCCCACTTGTATCCTCTG |
| 4820 | MPO | ATCTGTGTCCTGGTTAGCAGAGC |
| 4821 | MPO | CAGCTCAGGAACTAGACTGCCT |
| 4822 | MPO | CCCTCAAGGAGGTCTGG |
| 4823 | MPO | ACAGCTCAGGAACTAGACTGCCT |
| 4824 | MPO | AGGCAGCAGAGCGGACTGGTGA |
| 4825 | MPO | AAGGCAGCAGAGCGGACTGGTGA |
| 5322 | SERPIN | TGAAGCTCTCACACGCACAG |
| 5323 | SERPIN | CAGTCTGGAGGGTCCTGGCC |
| 5324 | SERPIN | CATGTGTGGCCCTGTCTGCTTA |
| 5325 | SERPIN | CCCATGGACTCTTCAGTCTGG |
| 5326 | SERPIN | ATGTGTGGCCCTGTCTGCTTA |
| 5327 | SERPIN | AGTAGGAACTTGGAATGCAAG |
| 5328 | SERPIN | GAAGCTCTCACACGCACAG |
| 5329 | SERPIN | CCTGTGCACCGTAGTGGCCATGG |
| 5330 | SERPIN | CTCTTCAGTCTGGAGGGTCCTGG |
| 5331 | SERPIN | GCCCATGGACTCTTCAGTCTGG |
| 5541 | TNFRSF | GTGAAAAACAACAAATTCAGTTCTGA |
| 5542 | TNFRSF | GTGACACACAGGTGTTCAAAGACG |
| 5543 | TNFRSF | GGCAAGACTGCCCTTAGAAATTCTAG |
| 5544 | TNFRSF | GCGTATGACACATTGA |
| 5545 | TNFRSF | GCCAGCCCTGGCTGCCCAGGCGGAG |
| 5546 | TNFRSF | GACGCTTCTGGGGAGTGAGGGAA |
| 5547 | TNFRSF | GACAATGTCCAAGCACAGCAGA |
| 5548 | TNFRSF | CTTTGCCACCTCTCCATTTTTGCC |
| 5549 | TNFRSF | CTGCCCTTAGAAATTCTAGCC |
| 5550 | TNFRSF | CTGGCTCAAAACTACCTA |
| 5551 | TNFRSF | CGCAAGAGTGACACACAGGTGTTCA |
| 5552 | TNFRSF | ATGTCCAAGACACAGCAGAACAGA |
| 5553 | TNFRSF | ATGCAGAAAGCACAGAAAGGA |
| 5554 | TNFRSF | ATGTAAACTGTGAAGATAGTT |
| 5555 | TNFRSF | ATGGAAAGAAAGAAGCGTATGACACA |
| 5556 | TNFRSF | ATGGAAAGAAAGAAGCGTATGACACAT |
| 5557 | TNFRSF | ATTTAAATAAGGCTCTACCTC |
| 5558 | TNFRSF | ACAATGTCCAAGACACAGCAGA |
| 5559 | TNFRSF | TCCTCAAGGACATTACTAG |
| 5560 | TNFRSF | TCTCAGGCATCAAAAGCATTTTG |
| 5561 | TNFRSF | TCCAAGGATGTTTAAAATCTAGTTGG |
| 5562 | TNFRSF | TGGGTGAAGAGAAAGGAAGTACAGA |
| 5563 | TNFRSF | TCTTTCTCAGGCATCAAAAGCATT |
| 5564 | TNFRSF | TTGGGTGAAGAGAAAGGAAGTACAGA |

Table 7, lines 1468-1501 shows data relating to target genes and binding site of GAM oligonucleotides.

TABLE 7

| GAM NAME | GAM RNA SEQUENCE | TARGET | TARGET REF-ID | TARGET UTRBS-SEQ | BINDING-SITE DRAW (UPPER:GAM; LOWER:TARGET) | GAM POS |
|---|---|---|---|---|---|---|
| GAM1032 | CTAGACTG AAG CTCCTTGA GGA | CHAT | NM_02 0984.1 | 5 | GCCTCA      -    ---     AA             A<br>AGGGGT CT AGA    CTG  GCTCCTTGAGG<br>G      GA TCT    GGC  TGGGGAACTCC<br>CGGCCC  C    CCC  G-             G<br>TCTCAG | A |
| GAM1032 | CTAGACTG AAG CTCCTTGA GGA | CTSK | NM_00 0396.2 | 3 | TCCTCA C      TGAAG  -   TAGAC<br>AGGTAG     CT CCTTGAGGA ATCTG<br>A          GA GGAACTCCT T<br>AATGTC      TAAA- T<br>TAT | A |
| GAM1032 | CTAGACTG AAG CTCCTTGA GGA | MPO | NM_00 0250.1 | 5 | CCCTCA       TGAAG         A<br>AGGAGG CTAGAC      CTCCTTGAGG<br>T CTGG GGTCTG      GAGGAACTCC<br>                -----         C | A |
| GAM1032 | CTAGACTG AAG CTCCTTGA GGA | MPO | NM_00 0250.1 | 5 | CCTCAA       TGAAG CTAGAC<br>GGAGGT       CTCCTTGAGG GGTCTG<br>C TGG        GAGGAACTCC     ----- | A |
| GAM1032 | CTAGACTG AAG CTCCTTGA GGA | SERPI NA 3 | NM_00 1085.2 | 3 | CCCATG           C-  T   A<br>GACTCT CTAGACTGAAG  TCC TG GG<br>T       GGTCTGACTTC  AGG AC CC<br>CAGTCT             TC   T   -<br>GG | A |
| GAM1032 | CTAGACTG AAG CTCCTTGA GGA | SERPI NA 3 | NM_00 1085.2 | 3 | GCCCAT           C-   T  A  A<br>GGACTC CTAGACTGAAG  TCC TG GG<br>T       GGTCTGACTTC  AGG AC CC<br>TCAGTC             TC   T  -  G<br>TGG | A |
| GAM1032 | CTAGACTG AAG CTCCTTGA GGA | TNFRS F6 | NM_15 2874.1 | 3 | TCCTCA     AC    AGC CTAG  TGA<br>AGGACA   TCCTTGAGGA GATC  ATT<br>T        AGGAACTCCT        --  AC-<br>TACTAG | A |

It is appreciated that the specific functions and accordingly the utilities a GAM oligonucleotide that is described by FIG. 8 is correlated with and may be deduced from the identity of the GAM TARGET GENES inhibited thereby, and whose functions are set forth in Table 8. Table 8 shows data relating to the function and utilities of GAM RNA as set forth in SEQ ID NO: 15.

TABLE 8

| GAM NAME | GAM TARGET | GAM RNA SEQUENCE | GAM FUNCTION | GAM POS | TAR DIS |
|---|---|---|---|---|---|
| GAM1 032 | TNFRSF 6 | CTAGACTG AAGCTCC TTGAGGA | TNFRSF6 (Accession NM_152874.1) is another GAM1032 target gene. TNFRSF6 BINDING SITE is a target binding site found in the 3' untranslated region of multiple transcripts of mRNA encoded by TNFRSF6, corresponding to a target binding site such as BINDING SITE I, BINDING SITE II or BINDING SITE III of FIG. 8. Nucleotide sequences of TNFRSF6 BINDING SITE, and secondary structure complementarity to the nucleotide sequence of GAM1032 RNA are set forth in | A | A |

TABLE 8-continued

| GAM NAME | GAM TARGET | GAM RNA SEQUENCE | GAM FUNCTION | GAM POS | TAR DIS |
|---|---|---|---|---|---|
| | | | Tables 6 and 7, hereby incorporated herein. Another function of GAM1032 is therefore inhibition of TNFRSF6. Accordingly, utilities of GAM1032 include diagnosis, prevention and treatment of Alzheimer, and of other diseases and clinical conditions associated with TNFRSF6. | | |
| GAM 1032 | CHAT | CTAGACTG AAGCTCC TTGAGGA | Choline Acetyltransferase (CHAT, Accession NM_020984.1) is a GAM1032 target gene. CHAT BINDING SITE is a target binding site found in the 5' untranslated region of multiple transcripts of mRNA encoded by CHAT, corresponding to a target binding site such as BINDING SITE I, BINDING SITE II or BINDING SITE III of FIG. 8. Nucleotide sequences of CHAT BINDING SITE, and secondary structure complementarity to the nucleotide sequence of GAM1032 RNA are set forth in Tables 6 and 7, hereby incorporated herein. A function of GAM1032 is therefore inhibition of CHAT, a GAM1032 target gene which synthesizes the neurotransmitter acetylcholine. and therefore is associated with Alzheimer. Accordingly, utilities of GAM1032 include diagnosis, prevention and treatment of Alzheimer, and of other diseases and clinical conditions associated with CHAT. The function of CHAT and its association with various diseases and clinical conditions, has been established by previous studies, as described hereinabove with reference to GAM335. | A | A |
| GAM1 032 | CTSK | CTAGACTG AAGCTCC TTGAGGA | CTSK (Accession NM_000396.2) is another GAM1032 target gene. CTSK BINDING SITE is a target binding site found in the 3' untranslated region of mRNA encoded by CTSK, corresponding to a target binding site such as BINDING SITE I, BINDING SITE II or BINDING SITE III of FIG. 8. Nucleotide sequences of CTSK BINDING SITE, and secondary structure complementarity to the nucleotide sequence of GAM1032 RNA are set forth in Tables 6 and 7, hereby incorporated herein. Another function of GAM1032 is therefore inhibition of CTSK. | A | A |

TABLE 8-continued

| GAM NAME | GAM TARGET | GAM RNA SEQUENCE | GAM FUNCTION | GAM POS | TAR DIS |
|---|---|---|---|---|---|
| | | | Accordingly, utilities of GAM1032 include diagnosis, prevention and treatment of Alzheimer, and of other diseases and clinical conditions associated with CTSK. | | |
| GAM1 032 | MPO | CTAGACTG AAGCTCC TTGAGGA | Myeloperoxidase (MPO, Accession NM_000250.1) is another GAM1032 target gene. MPO BINDING SITE1 and MPO BINDING SITE2 are target binding sites found in untranslated regions of mRNA encoded by MPO, corresponding to target binding sites such as BINDING SITE I, BINDING SITE II or BINDING SITE III of FIG. 8. Nucleotide sequences of MPO BINDING SITE1 and MPO BINDING SITE2, and secondary structure complementarity to the nucleotide sequence of GAM1032 RNA are set forth in Tables 6 and 7, hereby incorporated herein. Another function of GAM1032 is therefore inhibition of MPO, a GAM1032 target gene which is present in primary granules of neutrophilic granulocytes. and therefore is associated with Alzheimer. Accordingly, utilities of GAM1032 include diagnosis, prevention and treatment of Alzheimer, and of other diseases and clinical conditions associated with MPO. The function of MPO has been established by previous studies. Weil et al. (1988) found that the MPO gene was translocated to chromosome 15 in all cases of acute promyelocytic leukemia (subtype M3), which is consistently associated with the chromosomal translocation t(15;17)(q22;q11.2). In 2 of 4 cases examined by genomic blot analysis, rearrangement of the MPO gene was detected in leukemia cells. Weil et al. (1988) also suggested that MPO may be pivotal in the pathogenesis of APL. According to HGM10, the MPO gene is located at a distance from the breakpoint in APL, and the gene itself is probably usually not rearranged in APL. Myeloperoxidase has been detected in activated microglial macrophages and within amyloid plaques in the central nervous system. Using statistical analysis, Reynolds et al. (2000) examined the relationship between APOE (OMIM Ref. No. 107741) and MPO polymorphisms in the risk of | A | A |

TABLE 8-continued

| GAM NAME | GAM TARGET | GAM RNA SEQUENCE | GAM FUNCTION | GAM POS | TAR DIS |
|---|---|---|---|---|---|
| | | | Alzheimer disease (AD; 104300) in a genetically homogeneous Finnish population. They found that the presence of the MPO A allele in conjunction with APOE E4 significantly increased the risk of AD in men, but not in women (odds ratio for men with both alleles = 11.4 vs APOE E4 alone = 3.0). Reynolds et al. (2000) also found that estrogen receptor- alpha (OMIM Ref. No. 133430) binds to the MPO A promoter, which may explain the gender differences. Full details of the abovementioned studies are described in the following publications, the disclosure of which are hereby incorporated by reference: Reynolds, W. F.; Hiltunen, M.; Pirskanen, M.; Mannermaa, A.; Helisalmi, S.; Lehtovirta, M.; Alafuzoff, I.; Soininen, H.: MPO and APOE epsilon- 4 polymorphisms interact to increase risk for AD in Finnish males. Neurology 55: 1284-1290, 2000.; an Weil, S. C.; Rosner, G. L.; Reid, M. S.; Chisholm, R. L.; Lemons, R. S.; Swanson, M. S.; Carrino, J. J.; Diaz, M. O.; Le Beau, M. M.: Translocation and rearrangement of myeloperoxida Further studies establishing the function and utilities of MPO are found in John Hopkins OMIM database record ID 606989, and in cited publications listed in Table 9, hereby incorporated herein. | | |
| GAM1 032 | SERPIN A 3 | CTAGACTG AAGCTCC TTGAGGA | Serine (or cysteine) Proteinase Inhibitor, Clade A (alpha-1 antiprotei (SERPINA3, Accession NM_001085.2) is another GAM1032 target gene. SERPINA3 BINDING SITE1 and SERPINA3 BINDING SITE2 are target binding sites found in untranslated regions of mRNA encoded by SERPINA3, corresponding to target binding sites such as BINDING SITE I, BINDING SITE II or BINDING SITE III of FIG. 8. Nucleotide sequences of SERPINA3 BINDING SITE1 and SERPINA3 BINDING SITE2, and secondary structure complementarity to the nucleotide sequence of GAM1032 RNA are set forth in Tables 6 and 7, hereby incorporated herein. Another function of GAM1032 is therefore inhibition of SERPINA3, a GAM1032 target gene which is | A | A |

TABLE 8-continued

| GAM NAME | GAM RNA TARGET SEQUENCE | GAM FUNCTION | GAM POS | TAR DIS |
|---|---|---|---|---|
| | | a member of the serpin family of serine protease inhibitors. and therefore is associated with Alzheimer. Accordingly, utilities of GAM1032 include diagnosis, prevention and treatment of Alzheimer, and of other diseases and clinical conditions associated with SERPINA3. The function of SERPINA3 has been established by previous studies. Alpha-1-antichymotrypsin is a plasma protease inhibitor synthesized in the liver. It is a single glycopeptide chain of about 68,000 daltons and belongs to the class of serine protease inhibitors. In man, the normal serum level is about one-tenth that of alpha-1-antitrypsin (PI; 107400), with which it shares nucleic acid and protein sequence homology (Chandra et al. 1983). Both are major acute phase reactants; their concentrations in plasma Increase in response to trauma, surgery, and infection. Antithrombin III, which also is structurally similar to alpha-1-antitrypsin, shows less sequence homology to antichymotrypsin and is not an acute phase reactant. Kelsey et al. (1988) cloned and analyzed the AACT gene, partly because of the possibility that genetic variation in other protease inhibitors may influence the prognosis in AAT deficiency. They isolated the AACT gene on a series of cosmid clones, with restriction mapping of about 70 kb around the gene. Full details of the abovementioned studies are described in the following publications, the disclosure of which are hereby incorporated by reference: Chandra, T.; Stackhouse, R.; Kidd, V. J.; Robson, K. J. H.; Woo, S. L. C.: Sequence homology between human alpha-1-antichymotrypsin, alpha-1-antitrypsin, and antithrombin III. Biochemistry 22: 5055-5061, 1983.; an Kelsey, G. D.; Abeliovich, D.; McMahon, C. J.; Whitehouse, D.; Corney, G.; Povey, S.; Hopkinson, D. A.; Wolfe, J.; Mieli-Vergani, G.; Mowat, A. P.: Cloning of the human alpha-1 antichym Further studies establishing the function | | |

TABLE 8-continued

| GAM NAME | GAM RNA TARGET SEQUENCE | GAM FUNCTION | GAM POS | TAR DIS |
|---|---|---|---|---|
| | | and utilities of SERPINA3 are found in John Hopkins OMIM database record ID 107280, and in cited publications listed in Table 9, hereby incorporated herein. | | |

Studies documenting the well known correlations between GAM TARGET GENEs that are described by FIG. 8 and the known gene functions and related diseases are listed in Table 9. Specifically, Table 9 describes references of GAM target genes, as set forth in SEQ ID NO:15 in Table 8.

TABLE 9

| GAM NAME | GAM RNA SEQUENCE | TARGET | REFERENCES | GAM POS |
|---|---|---|---|---|
| GAM103 2 | CTAGAC TGAAGC TC CTTGAG GA | CHAT | Barrard, B. A.; Lottspeich, F.; Braun, A.; Barde, Y. A.; Mallet, J.: cDNA cloning and complete sequence of porcine choline acetyltransferase: in vitro translation of the corresponding RNA yields an active protein. Proc. Nat. Acad. Sci. 84:9280-9284, 1987. | A |
| GAM103 2 | CTAGAC TGAAGC TC CTTGAG GA | CHAT | Chireux, M. A.; Le Van Thai, A.; Weber, M. J.: Human choline acetyltransferasegene: localization of alternative first exons. J. Neurosci. Res. 40:427-438, 1995. | A |
| GAM103 2 | CTAGAC TGAAGC TC CTTGAG GA | CHAT | Cohen-Haguenauer, O.; Brice, A.; Berrard, S.; Van Cong, N.; Mallet, J.; Frezal, J.: Localization of the choline acetyltransferase (CHAT)gene to human chromosome 10. Genomics 6:374-378, 1990. | A |
| GAM103 2 | CTAGAC TGAAGC TC CTTGAG GA | CHAT | Erickson, J. D.; Varoqui, H.; Schafer, M. K.-H.; Modi, W.; Diebler, M.-F.; Weihe, E.; Rand, J.; Eiden, L. E.; Bonner, T. I.; Usdin, T. B.: Functional identification of a vesicular acetylcholine transporter and its expression from a 'cholinergic' gene locus. J. Biol. Chem. 269:21929-21932, 1994. | A |
| GAM103 2 | CTAGAC TGAAGC TC CTTGAG GA | CHAT | Misawa, H.; Ishii, K.; Deguchi, T.: Gene expression of mouse cholineacetyltransferase: alternative splicing and identification of a highlyactive promoter region. J. Biol. Chem. 267: 20392-20399, 1992. | A |
| GAM103 2 | CTAGAC TGAAGC TC CTTGAG GA | CHAT | Ohno, K.; Tsujino, A.; Brengman, J. M.; Harper, C. M.; Bajzer, Z.; Udd, B.; Beyring, R.; Robb, S.; Kirkham, F. J.; Engel, A. G.: Choline acetyltransferase mutations cause myasthenic syndrome associated with episodic apnea in humans. Proc. Nat. Acad. Sci. 98:2017-2022, 2001. | A |
| GAM103 2 | CTAGAC TGAAGC TC CTTGAG GA | CHAT | Strauss, W. L.; Kemper, R. R.; Jayakar, P.; Kong, C. F.; Hersh, L. B.; Hilt, D. C.; Rabin, M.: Human choline acetyltransferase genemaps to region 10q11-q22.2 by in situ hybridization. Genomics 9:396-398, 1991. | A |

TABLE 9-continued

| GAM NAME | GAM RNA SEQUENCE | TARGET | REFERENCES | GAM POS |
|---|---|---|---|---|
| GAM1032 | CTAGAC TGAAGC TC CTTGAG GA | CHAT | Toussaint, J. L.; Geoffroy, V.; Schmitt, M.; Werner, A.; Garnier, J. M.; Simoni, P.; Kempf, J.: Human choline acetyltransferase (CHAT): partial gene sequence and potential control regions. Genomics 12:412-416, 1992. | A |
| GAM1032 | CTAGAC TGAAGC TC CTTGAG GA | CHAT | Viegas-Pequignot, E.; Berrard, S.; Brice, A.; Apiou, F.; Mallet, J.: Localization of a 900-bp-long fragment of the human choline acetyltransferasegene to 10q11.2 by nonradioactive in situ hybridization. Genomics 9:210-212, 1991. | A |
| GAM1032 | CTAGAC TGAAGC TC CTTGAG GA | MPO | Borregaard, N.; Cowland, J. B.: Granules of the human neutrophilicpolymorphonuclear leukocyte. Blood 89:3503-3521, 1997. | A |
| GAM1032 | CTAGAC TGAAGC TC CTTGAG GA | MPO | Chang, K. S.; Schroeder, W.; Siciliano, M. J.; Thompson, L. H.; McCredie, K.; Beran, M.; Freireich, E. J.; Liang, J. C.; Trujillo, J. M.; Stass, S. A.: The localization of the human myeloperoxidasegene is in close proximity to the translocation breakpoint in acutepromyelocytic leukemia. Leukemia 1:458-462, 1987. | A |
| GAM1032 | CTAGAC TGAAGC TC CTTGAG GA | MPO | DeLeo, F. R.; Goedken, M.; McCormick, S. J.; Nauseef, W. M.: Anovel form of hereditary myeloperoxidase deficiency linked to endoplasmicreticulum/proteasome degradation. J. Clin. Invest. 101: 2900-2909, 1998. | A |
| GAM1032 | CTAGAC TGAAGC TC CTTGAG GA | MPO | Eiserich, J. P.; Baldus, S.; Brennan, M.-L.; Ma, W.; Zhang, C.; Tousson, A.; Castro, L.; Lusis, A. J.; Nauseef, W. M.; White, C. R.; Freeman, B. A.: Myeloperoxidase, a leukocyte-derived vascular NOoxidase. Science 296:2391-2394, 2002. | A |
| GAM1032 | CTAGAC TGAAGC TC CTTGAG GA | MPO | Inazawa, J.; Inoue, K.; Nishigaki, H.; Tsuda, S.; Taniwaki, M.; Misawa, S.; Abe, T.: Assignment of the human myeloperoxidase gene(MPO) to bands q21.3-q23 of chromosome 17. Cytogenet. Cell Genet. 50:135-136, 1989. | A |
| GAM1032 | CTAGAC TGAAGC TC CTTGAG GA | MPO | Johnson, K.; Gemperlein, I.; Hudson, S.; Shane, S.; Rovera, G.: Complete nucleotide sequence of the human myeloperoxidase gene. NucleicAcids Res. 17:7985-7986, 1989. | A |
| GAM1032 | CTAGAC TGAAGC TC CTTGAG GA | MPO | Kizaki, M.; Miller, C. W.; Selsted, M. E.; Koeffler, H. P.: Myeloperoxidase(MPO) gene mutation in hereditary MPO deficiency. Blood 83:1935-1940, 1994. | A |
| GAM1032 | CTAGAC TGAAGC TC CTTGAG GA | MPO | Klebanoff, S. J.: Myeloperoxidase. Proc. Assoc. Am. Physicians 111:383-389, 1999. | A |

TABLE 9-continued

| GAM NAME | GAM RNA SEQUENCE | TARGET | REFERENCES | GAM POS |
|---|---|---|---|---|
| GAM103 2 | CTAGAC TGAAGC TC CTTGAG GA | MPO | Kudoh, J.; Minoshima, S.; Hashinaka, K.; Nishio, C.; Yamada, M.; Shimizu, Y.; Shimizu, N.: Assignment of the myeloperoxidase (MPO) gene to human chromosome 17. (Abstract) Cytogenet. Cell Genet. 46:641-642, 1987. | A |
| GAM103 2 | CTAGAC TGAAGC TC CTTGAG GA | MPO | Kudoh, J.; Minoshima, S.; Hashinaka, K.; Nishio, C.; Yamada, M.; Shimizu, Y.; Shimizu, N.: Assignment of the myeloperoxidase geneMPO to human chromosome 17 using somatic cell hybrids and flow-sortedchromosomes. Jpn. J. Hum. Genet. 33:315-324, 1988. | A |
| GAM103 2 | CTAGAC TGAAGC TC CTTGAG GA | MPO | Law, D. J.; Prasad, M. A.; King, S. E.; Spranger, K. D.; Lee, Y. H.; Fox, R. E.; Collins, E. E.; Gebuhr, T. C.; Miller, D. E.; Petty, E. M.: Localization of the human estrogen-responsive finger protein(EFP) gene (ZNF147) within a YAC contig containing the myeloperoxidase(MPO) gene. Genomics 28:361-363, 1995. | A |
| GAM103 2 | CTAGAC TGAAGC TC CTTGAG GA | MPO | Le Beau, M. M.; Lemons, R. S.; Rosner, G. L.; Carrino, J. C.; Reid, M. S.; Chisholm, R. L.; Diaz, M. O.; Weil, S. C.: Chromosomallocalization of the gene encoding myeloperoxidase. (Abstract) Cytogenet.Cell Genet. 46:645, 1987. | A |
| GAM103 2 | CTAGAC TGAAGC TC CTTGAG GA | MPO | Liang, J. C.; Chang, K. S.; Schroeder, W. T.; Freireich, E. J.; Stass, S. A.; Trujillo, J. M.: The myeloperoxidase gene is translocatedfrom chromosome 17 to 15 in a patient with acute promyelocytic leukemia. CancerGenet. Cytogenet. 30:103-107, 1988. | A |
| GAM103 2 | CTAGAC TGAAGC TC CTTGAG GA | MPO | Liang, J. C.; Chang, K. S.; Schroeder, W.; Siciliano, M.; Trujillo, J.; Stass, S.: The human myeloperoxidase gene locates on chromosome 17q22-24 and is translocated in acute promyelocytic leukemia. (Abstract) Am. J. Hum. Genet. 41:A226, 1987. | A |
| GAM103 2 | CTAGAC TGAAGC TC CTTGAG GA | MPO | Miki, T.; Weil, S. C.; Rosner, G. L.; Reid, M. S.; Kidd, K. K.: An MPO cDNA clone identifies an RFLP with PstI. Nucleic Acids Res. 16:1649, 1988. | A |
| GAM103 2 | CTAGAC TGAAGC TC CTTGAG GA | MPO | Morishita, K.; Kubota, N.; Asano, S.; Kaziro, Y.; Nagata, S.: Molecular cloning and characterization of cDNA for human myeloperoxidase. J. Biol. Chem. 262:3844-3851, 1987. | A |
| GAM103 2 | CTAGAC TGAAGC TC CTTGAG GA | MPO | Murao, S.-I.; Stevens, F. J.; Ito, A.; Huberman, E.: Myeloperoxidase: a myeloid cell nuclear antigen with DNA-binding properties. Proc. Nat. Acad. Sci. 85:1232-1236, 1988. | A |
| GAM103 2 | CTAGAC TGAAGC TC CTTGAG GA | MPO | Nauseef, W. M.; Brigham, S.; Cogley, M.: Hereditary myeloperoxidasedeficiency due to a missense mutation of arginine 569 to tryptophan. J. Biol. Chem. 269:1212-1216, 1994. | A |

TABLE 9-continued

| GAM NAME | GAM RNA SEQUENCE | TARGET | REFERENCES | GAM POS |
|---|---|---|---|---|
| GAM103 2 | CTAGAC TGAAGC TC CTTGAG GA | MPO | Nauseef, W. M.; Olsson, I.; Arnljots, K.: Biosynthesis and processing of myeloperoxidase - - a marker for myeloid cell differentiation. Europ. J. Haemat. 40:97-110, 1988. | A |
| GAM103 2 | CTAGAC TGAAGC TC CTTGAG GA | MPO | Nauseef, W.; Cogley, M.; McCormick, S.: Effect of the R569W missensemutation on the biosynthesis of myeloperoxidase. J. Biol. Chem. 271:9546-9549, 1996. | A |
| GAM103 2 | CTAGAC TGAAGC TC CTTGAG GA | MPO | Reynolds, W. F.; Hiltunen, M.; Pirskanen, M.; Mannermaa, A.; Helisalmi, S.; Lehtovirta, M.; Alafuzoff, I.; Soininen, H.: MPO and APOE epsilon-4polymorphisms interact to increase risk for AD in Finnish males. Neurology 55:1284-1290, 2000. | A |
| GAM103 2 | CTAGAC TGAAGC TC CTTGAG GA | MPO | Robinson, T. J.; Morris, D. J.; Ledbetter, D. H.: Chromosomalassignment and regional localization of myeloperoxidase in the mouse. Cytogenet. Cell Genet. 53: 83-86, 1990. | A |
| GAM103 2 | CTAGAC TGAAGC TC CTTGAG GA | MPO | Romano, M.; Dri, P.; Dadalt, L.; Patriarca, P.; Baralle, F. E.: Biochemical and molecular characterization of hereditary myeloproliferativedeficiency. Blood 90:4126-4134, 1997. | A |
| GAM103 2 | CTAGAC TGAAGC TC CTTGAG GA | MPO | van Tuinen, P.; Johnson, K. R.; Ledbetter, S. A.; Nussbaum, R. L.; Rovera, G.; Ledbetter, D. H.: Localization of myeloperoxidaseto the long arm of human chromosome 17: relationship to the 15;17translocation of acute promyelocytic leukemia. Oncogene 1: 319-322, 1987. | A |
| GAM103 2 | CTAGAC TGAAGC TC CTTGAG GA | MPO | Weil, S. C.; Rosner, G. L.; Reid, M. S.; Chisholm, R. L.; Farber, N. M.; Spitznagel, J. K.; Swanson, M. S.: cDNA cloning of human myeloperoxidase: decrease in myeloperoxidase mRNA upon induction of HL-60 cells. Proc. Nat. Acad. Sci. 84:2057-2061, 1987. | A |
| GAM103 2 | CTAGAC TGAAGC TC CTTGAG GA | MPO | Weil, S. C.; Rosner, G. L.; Reid, M. S.; Chisholm, R. L.; Lemons, R. S.; Swanson, M. S.; Carrino, J. J.; Diaz, M. O.; Le Beau, M. M.: Translocation and rearrangement of myeloperoxidase gene in acutepromyelocytic leukemia. Science 240:790-792, 1988. | A |
| GAM103 2 | CTAGAC TGAAGC TC CTTGAG GA | MPO | Yamada, M.; Hur, S.-J.; Hashinaka, K.; Tsuneoka, K.; Saeki, T.; Nishio, C.; Sakiyama, F.; Tsunasawa, S.: Isolation and characterization of a cDNA coding for human myeloperoxidase. Arch. Biochem. Biophys. 255:147-155, 1987. | A |
| GAM103 2 | CTAGAC TGAAGC TC CTTGAG | MPO | Zaki, S. R.; Austin, G. E.; Chan, W. C.; Conaty, A. L.; Trusler, S.; Trappier, S.; Lindsey, R. B.; Swan, D. C.: Chromosomal localization of | A |

TABLE 9-continued

| GAM NAME | GAM RNA SEQUENCE | TARGET | REFERENCES | GAM POS |
|---|---|---|---|---|
| | GA | | the human myeloperoxidase gene by in situ hybridization using oligonucleotideprobes. Genes Chromosomes Cancer 2:266-270, 1990. | |
| GAM103 2 | CTAGAC TGAAGC TC CTTGAG GA | SERPIN A3 | Chandra, T.; Stackhouse, R.; Kidd, V. J.; Robson, K. J. H.; Woo, S. L. C.: Sequence homology between human alpha-1-antichymotrypsin, alpha-1-antitrypsin, and antithrombin III. Biochemistry 22:5055-5061, 1983. | A |
| GAM103 2 | CTAGAC TGAAGC TC CTTGAG GA | SERPIN A3 | Eriksson, S.; Lindmark, B.; Lilia, H.: Familial alpha-1-antichymotrypsindeficiency. Acta Med. Scand. 220:447-453, 1986. | A |
| GAM103 2 | CTAGAC TGAAGC TC CTTGAG GA | SERPIN A3 | Gilfix, B. M.; Briones, L.: Absence of the A1252G mutation inalpha 1-antichymotrypsin in a North American population suffering from dementia. J. Cereb. Blood Flow Metab. 17:233-235, 1997. | A |
| GAM103 2 | CTAGAC TGAAGC TC CTTGAG GA | SERPIN A3 | Haines, J. L.; Pritchard, M. L.; Saunders, A. M.; Schildkraut, J. M.; Growdon, J. H.; Gaskell, P. C.; Farrer, L. A.; Auerbach, S. A.; Gusella, J. F.; Locke, P. A.; Rosi, B. L.; Yamaoka, L.; Small, G. W.; Conneally, P. M.; Roses, A. D.; Pericak-Vance, M. A.: No geneticeffect of alpha-1-antichymotrypsin in Alzheimer disease. Genomics 33:53-56, 1996. | A |
| GAM103 2 | CTAGAC TGAAGC TC CTTGAG GA | SERPIN A3 | Haines, J. L.; Scott, W. K.; Pericak-Vance, M. A.: Reply to 'Geneticeffect of alpha-1-antichymotrypsin on the risk of Alzheimer disease.' (Letter) Genomics 40:384-385, 1997. | A |
| GAM103 2 | CTAGAC TGAAGC TC CTTGAG GA | SERPIN A3 | Kamboh, M. I.; Aston, C. E.; Ferrell, R. E.; Dekosky, S. T.: Geneticeffect of alpha-1-antichymotrypsin on the risk of Alzheimer disease. (Letter) Genomics 41:382-385, 1997. | A |
| GAM103 2 | CTAGAC TGAAGC TC CTTGAG GA | SERPIN A3 | Kamboh, M. I.; Sanghera, D. K.; Ferrell, R. E.; DeKosky, S. T.: APOE*4 - associated Alzheimer's disease risk is modified by alpha-1-antichymotrypsinpolymorphism. Nature Genet. 10:486-488, 1995. | A |
| GAM103 2 | CTAGAC TGAAGC TC CTTGAG GA | SERPIN A3 | Kelsey, G. D.; Abeliovich, D.; McMahon, C. J.; Whitehouse, D.; Corney, G.; Povey, S.; Hopkinson, D. A.; Wolfe, J.; Mieli-Vergani, G.; Mowat, A. P.: Cloning of the human alpha-1 antichymotrypsin geneand genetic analysis of the gene in relation to alpha-1 antitrypsindeficiency. J. Med. Genet. 25:361-368, 1988. | A |
| GAM103 2 | CTAGAC TGAAGC TC CTTGAG GA | SERPIN A3 | Morgan, K.; Licastro, F.; Tilley, L.; Ritchie, A.; Morgan, L.; Pedrini, S.; Kalsheker, N.: Polymorphism in the alpha-1-antichymotrypsin(ACT) gene promoter: effect on expression in transfected glial and liver cell lines and plasma ACT concentrations. Hum. Genet. 109:303-310, 2001. | A |

TABLE 9-continued

| GAM NAME | GAM RNA SEQUENCE | TARGET | REFERENCES | GAM POS |
|---|---|---|---|---|
| GAM103 2 | CTAGAC TGAAGC TC CTTGAG GA | SERPIN A3 | Morgan, K.; Morgan, L.; Carpenter, K.; Lowe, J.; Lam, L.; Cave, S.; Xuereb, J.; Wischik, C.; Harrington, C.; Kalsheker, N. A.: Microsatellitepolymorphism of the alpha-1-antichymotrypsin gene locus associated with sporadic Alzheimer's disease. Hum. Genet. 99: 27-31, 1997. | A |
| GAM103 2 | CTAGAC TGAAGC TC CTTGAG GA | SERPIN A3 | Munoz, E.; Obach, V.; Oliva, R.; Marti, M. J.; Ezquerra, M.; Pastor, P.; Ballesta, F.; Tolosa, E.: Alpha-1-antichymotrypsin gene polymorphism and susceptibility to Parkinson's disease. Neurology 52: 297-301, 1999. | A |
| GAM103 2 | CTAGAC TGAAGC TC CTTGAG GA | SERPIN A3 | Poller, W.; Faber, J.-P.; Scholz, S.; Weidinger, S.; Bartholome, K.; Olek, K.; Eriksson, S.: Mis-sense mutation of alpha-1-antichymotrypsingene associated with chronic lung disease. (Letter) Lancet 339:1538, 1992. | A |
| GAM103 2 | CTAGAC TGAAGC TC CTTGAG GA | SERPIN A3 | Poller, W.; Faber, J.-P.; Weidinger, S.; Tief, K.; Scholz, S.; Fischer, M.; Olek, K.; Kirchgesser, M.; Heidtmann, H.-H.: A leucine-to-prolinesubstitution causes a defective alpha-1-antichymotrypsin allele associated with familial obstructive lung disease. Genomics 17:740-743, 1993. | A |
| GAM103 2 | CTAGAC TGAAGC TC CTTGAG GA | SERPIN A3 | Rabin, M.; Watson, M.; Breg, W. R.; Kidd, V.; Woo, S. L. C.; Ruddle, F. H.: Human alpha-1-antichymotrypsin and alpha-1-antitrypsin (PI)genes map to the same region on chromosome 14. (Abstract) Cytogenet. Cell Genet. 40: 728, 1985. | A |
| GAM103 2 | CTAGAC TGAAGC TC CTTGAG GA | SERPIN A3 | Rabin, M.; Watson, M.; Kidd, V.; Woo, S. L. C.; Breg, W. R.; Ruddle, F. H.: Regional location of alpha-1-antichymotrypsin and alpha-1-antitrypsingenes on human chromosome 14. Somat. Cell Molec. Genet. 12: 209-214, 1986. | A |
| GAM103 2 | CTAGAC TGAAGC TC CTTGAG GA | SERPIN A3 | Samilchuk, E. I.; Chuchalin, A. G.: Mis-sense mutation of alpha-1-antichymotrypsingene and chronic lung disease. (Letter) Lancet 342: 624, 1993. | A |
| GAM103 2 | CTAGAC TGAAGC TC CTTGAG GA | SERPIN A3 | Sefton, L.; Kearney, P.; Kelsey, G.; Povey, S.; Wolfe, J.: Physical linkage of the genes PI and AACT. (Abstract) Cytogenet. Cell Genet. 51:1076, 1989. | A |
| GAM103 2 | CTAGAC TGAAGC TC CTTGAG GA | SERPIN A3 | Sefton, L.; Kelsey, G.; Kearney, P.; Povey, S.; Wolfe, J.: Aphysical map of the human PI and AACT genes. Genomics 7:382-388, 1990. | A |
| GAM103 2 | CTAGAC TGAAGC TC CTTGAG | SERPIN A3 | Tachikawa, H.; Tsuda, M.; Onoe, K.; Ueno, M.; Takagi, S.; Shinohara, Y.: Alpha-1-antichymotrypsin gene A1252G variant (ACT Isehara-1) is | A |

TABLE 9-continued

| GAM NAME | GAM RNA SEQUENCE | TARGET | REFERENCES | GAM POS |
|---|---|---|---|---|
| | GA | | associated with a lacunar type of ischemic cerebrovascular disease. J. Hum. Genet. 46:45-47, 2001. | |
| GAM103 2 | CTAGAC TGAAGC TC CTTGAG GA | SERPIN A3 | Tsuda, M.; Sei, Y.; Matsumoto, M.; Kamiguchi, H.; Yamamoto, M.; Shinohara, Y.; Igarashi, T.; Yamamura, M.: Alpha-1-antichymotrypsinvariant detected by PCR - single strand conformation polymorphism (PCR-SSCP)and direct sequencing. Hum. Genet. 90:467-468, 1992. | A |
| GAM103 2 | CTAGAC TGAAGC TC CTTGAG GA | SERPIN A3 | Tsuda, M.; Sei, Y.; Yamamura, M.; Yamamoto, M.; Shinohara, Y.: Detection of a new mutant alpha-1-antichymotrypsin in patients with occlusive-cerebrovascular disease. FEBS Lett. 304:66-68, 1992. | A |
| GAM103 2 | CTAGAC TGAAGC TC CTTGAG GA | SERPIN A3 | Wang, X.; DeKosky, S. T.; Luedecking-Zimmer, E.; Ganguli, M.; Kamboh, M. I.: Genetic variation in alpha-1-antichymotrypsin and its association with Alzheimer's disease. Hum. Genet. 110:356-365, 2002. | A |
| GAM103 2 | CTAGAC TGAAGC TC CTTGAG GA | SERPIN A3 | Yamamoto, M.; Kondo, I.; Ogawa, N.; Asanuma, M.; Yamashita, Y.; Mizuno, Y.: Genetic association between susceptibility to Parkinson's disease and alpha-1-antichymotrypsin polymorphism. Brain Res. 759:153-155, 1997. | A |

Table 11 shows data relating to Alzheimer's and ALL diseases for which GAM RNA SEQ ID NO: 15 is predicted to regulate the disease-associated genes.

TABLE 11

| ROW # | DISEASE NAME | TARGET-GENES ASSOCIATED WITH ALZHEIMER DISEASE |
|---|---|---|
| 1 | ALL | PLAU, CNTF, AVP, CRYAB, SNCB, APBA2, DHCR24, CTNND2, PSEN1, APLP1, GSK3B, APPBP2, DSCR1, MME, CRAT, AGER, NCSTN, ABCD1, BCHE, A2M, MTNR1A, APOC1, THOP1, APBA1, SERPINA3, ACHE, UBB, PIN1, TNFSF5, ADAM17, BACE2, PLCD1, APLP2, CTSK, BACE, SOD2, ADAM10, DLST, CTSG,NPY, OGDH, GYPA, PRND, CHAT, PSEN2, ACE, RAGE, GAL, APBB1, TRPM2, GSN, SNCA, BLMH, IL1A, TNFRSF6, HADH2, FHL2, ARHA, MAPK10, SLC6A4, OLR1, TGFB1, FLNB, TNF, ADAMTS5, SNCAIP, SNCG, MAPT, TFCP2, TNFRSF5, IAPP, CLU, B2M, VLDLR, GLUL, CAV2, IDE, NCKAP1, APBB2, FOS, ESR2, ACT, NGB, FPRL1, HTR2C, APCS, IGF1, CASP3, IL1B, HTR2A, GFAP, CRH, APP, SLC17A7, LRP1, PRNP, MPO, NOTCH1, S100B, MT3, CAV1, HD, BAX and CTSB. |
| 2 | Alzheimer | AVP, NCSTN, ARHA, APPBP2, HTR2A, PSEN1, DHCR24, PLAU, MTNR1A, SERPINA3, DSCR1, APBA1, APOC1, BCHE, MME, BACE2, UBB, CTNND2, APLP1, APP, SLC17A7, NCKAP1, GFAP, IGF1, SLC6A4, HD, S100B, CASP3, MPO, CNTF, GSK3B, CRH, LRP1, MT3, APBA2, CAV1, CRYAB, MAPK10, TGFB1, CHAT, TNFRSF5, CTSB, MAPT, OLR1, FLNB, |

TABLE 11-continued

| ROW # | DISEASE NAME | TARGET-GENES ASSOCIATED WITH ALZHEIMER DISEASE |
|---|---|---|
| | | CAV2, GLUL, IAPP, NGB, ACT, FOS, APBB2, TNF, SNCAIP, APLP2, PSEN2, OGDH, GYPA, ADAM17, ADAM10, ADAMTS5, BACE, TNFRSF6, ACE, HTR2C, RAGE, HADH2, FHL2, PRND, IL1A, SNCA, DLST, CTSK, TRPM2, BLMH. |

The present invention discloses a novel group of oligonucleotides, belonging to the miRNA-like oligonucleotides group, here termed GAM oligonucleotides, for which a specific complementary binding has been determined bioinformatically.

Figure 9:
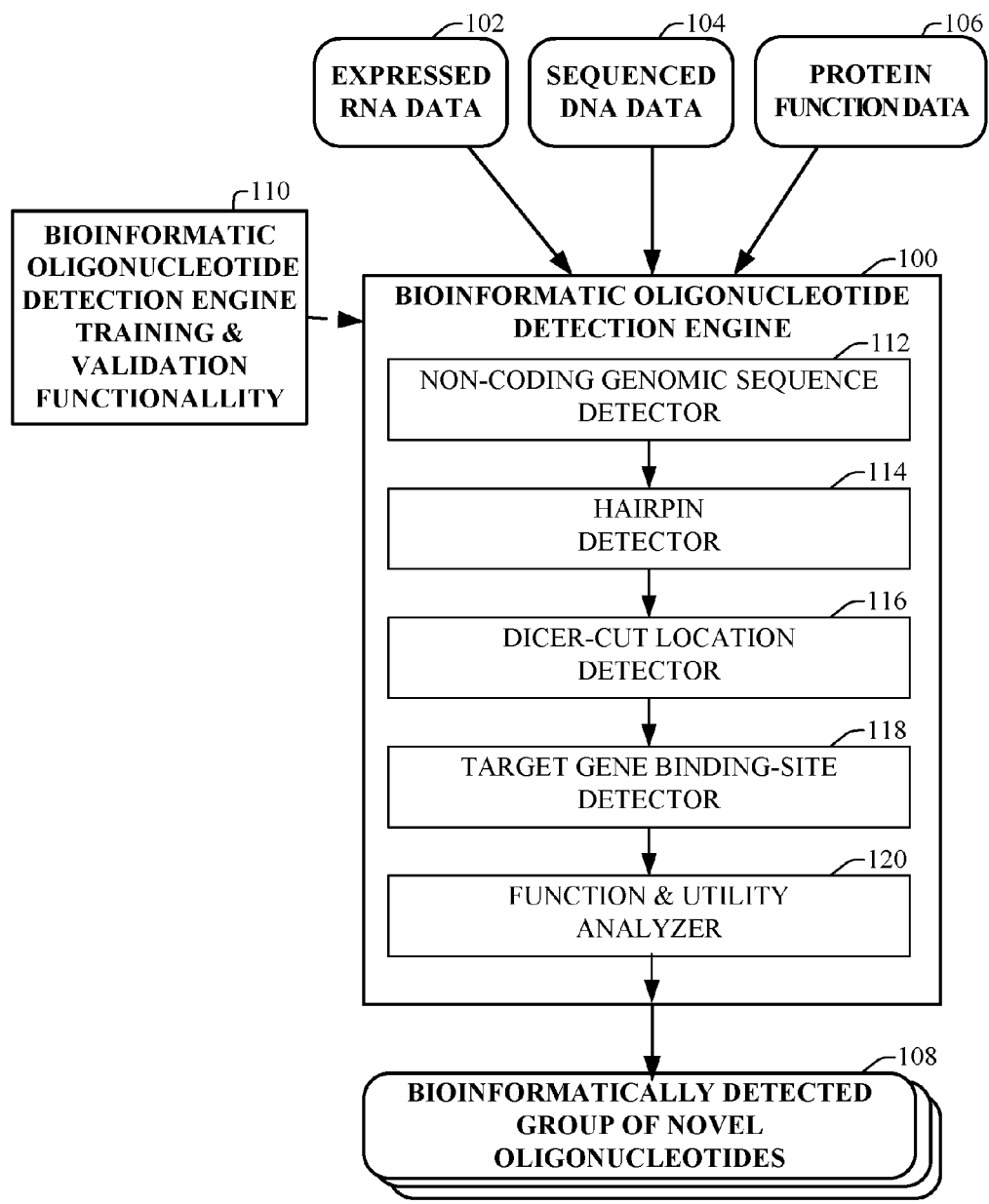
FIG. 9 is a simplified block diagram illustrating a bioinformatic oligonucleotide detection system capable of detecting oligonucleotides of the novel group of oligonucleotides of the present invention, which system is constructed and operative in accordance with a preferred embodiment of the present invention.

Reference is now made to FIG. 9 which is a simplified block diagram illustrating a bioinformatic oligonucleotide detection system and method constructed and operative in accordance with a preferred embodiment of the present invention.

An important feature of the present invention is a BIOINFORMATIC OLIGONUCLEOTIDE DETECTION ENGINE 100, which is capable of bioinformatically detecting oligonucleotides of the present invention.

The functionality of the BIOINFORMATIC OLIGONUCLEOTIDE DETECTION ENGINE 100 includes receiving EXPRESSED RNA DATA 102, SEQUENCED DNA DATA 104, and PROTEIN FUNCTION DATA 106; performing a complex process of analysis of this data as elaborated hereinbelow, and based on this analysis provides information, designated by reference numeral 108, identifying and describing features of novel oligonucleotides.

EXPRESSED RNA DATA 102 comprises published expressed sequence tags (EST) data, published mRNA data, as well as other published RNA data. SEQUENCED DNA DATA 104 comprises alphanumeric data representing genomic sequences and preferably including annotations such as information indicating the location of known protein coding regions relative to the genomic sequences.

PROTEIN FUNCTION DATA 106 comprises information from scientific publications e.g. physiological functions of known proteins and their connection, involvement and possible utility in treatment and diagnosis of various diseases.

EXPRESSED RNA DATA 102 and SEQUENCED DNA DATA 104 may preferably be obtained from data published by the National Center for Biotechnology Information (NCBI) at the National Institute of Health (NIH) (Oenuth J. P. (2000). Methods Mol. Biol. 132:301-312 (2000), herein incorporated by reference).

, as well as from various other published data sources. PROTEIN FUNCTION DATA 106 may preferably be obtained from any one of numerous relevant published data sources, such as the Online Mendelian Inherited Disease In Man (OMIM™, Hamosh et al., Nucleic Acids Res. 30: 52-55 (2002)) database developed by John Hopkins University, and also published by NCBI (2000).

Prior to or during actual detection of BIOINFORMATICALLY DETECTED GROUP OF NOVEL OLIGONUCLEOTIDES 108 by the BIOINFORMATIC OLIGONUCLEOTIDE DETECTION ENGINE 100, BIOINFORMATIC OLIGONUCLEOTIDE DETECTION ENGINE TRAINING & VALIDATION FUNCTIONALITY 110 is operative. This functionality uses one or more known miRNA oligonucleotides as a training set to train the BIOINFORMATIC OLIGONUCLEOTIDE DETECTION ENGINE 100 to bioinformatically recognize miRNA-like oligonucleotides, and their respective potential target binding sites. BIOINFORMATIC OLIGONUCLEOTIDE DETECTION ENGINE TRAINING & VALIDATION FUNCTIONALITY 110 is further described hereinbelow with reference to FIG. 10.

The BIOINFORMATIC OLIGONUCLEOTIDE DETECTION ENGINE 100 preferably comprises several modules which are preferably activated sequentially, and are described as follows:

A NON-CODING GENOMIC SEQUENCE DETECTOR 112 operative to bioinformatically detect non-protein coding genomic sequences. The NON-CODING GENOMIC SEQUENCE DETECTOR 112 is further described herein below with reference to FIGS. 11A and 11B.

A HAIRPIN DETECTOR 114 operative to bioinformatically detect genomic 'hairpin-shaped' sequences, similar to GAM FOLDED PRECURSOR RNA (FIG. 8). The HAIRPIN DETECTOR 114 is further described herein below with reference to FIGS. 12A and 12B.

A DICER-CUT LOCATION DETECTOR 116 operative to bioinformatically detect the location on a GAM FOLDED PRECURSOR RNA which is enzymatically cut by DICER COMPLEX (FIG. 8), yielding diced GAM RNA. The DICER-CUT LOCATION DETECTOR 116 is further described herein below with reference to FIGS. 13A-13C.

A TARGET GENE BINDING-SITE DETECTOR 118 operative to bioinformatically detect target genes having binding sites, the nucleotide sequence of which is partially complementary to that of a given genomic sequence, such as a nucleotide sequence cut by DICER COMPLEX. The TARGET GENE BINDING-SITE DETECTOR 118 is further described hereinbelow with reference to FIGS. 14A and 14B.

A FUNCTION & UTILITY ANALYZER 120 operative to analyze function and utility of target genes, in order to identify target genes which have a significant clinical function and utility. The FUNCTION & UTILITY ANALYZER 120 is further described hereinbelow with reference to FIG. 15.

According to a preferred embodiment of the present invention the engine 100 may employ a cluster of 40 PCs (XEON®, 2.8 GHz, with 80 GB storage each), connected by Ethernet to 8 servers (2-CPU, XEON™ 1.2-2.2 GHz, with ~200 GB storage each), combined with an 8-processor server (8-CPU, Xeon 550 Mhz w/8 GB RAM) connected via 2 HBA fiber-channels to an EMC CLARION™ 100-disks, 3.6 terabyte storage device. A preferred embodiment of the present invention may also preferably comprise software which utilizes a commercial database software program, such as MICROSOFT™ SQL Server 2000. It is appreciated that the above mentioned hardware configuration is not meant to be limiting, and is given as an illustration only. The present invention may be implemented in a wide variety of hardware and software configurations.

The present invention discloses 1708 novel oligonucleotides of the GAM group of oligonucleotides, which have been detected bioinformatically, as set forth in Tables 1-4, and 246 novel polynucleotides of the GR group of polynucleotides, which have been detected bioinformatically. Laboratory confirmation of 43 bioinformatically predicted oligonucleotides of the GAM group of oligonucleotides, and several bioinformatically predicted polynucleotides of the GR group of polynucleotides, is described hereinbelow with reference to FIGS. 21-24D.

Figure 10:
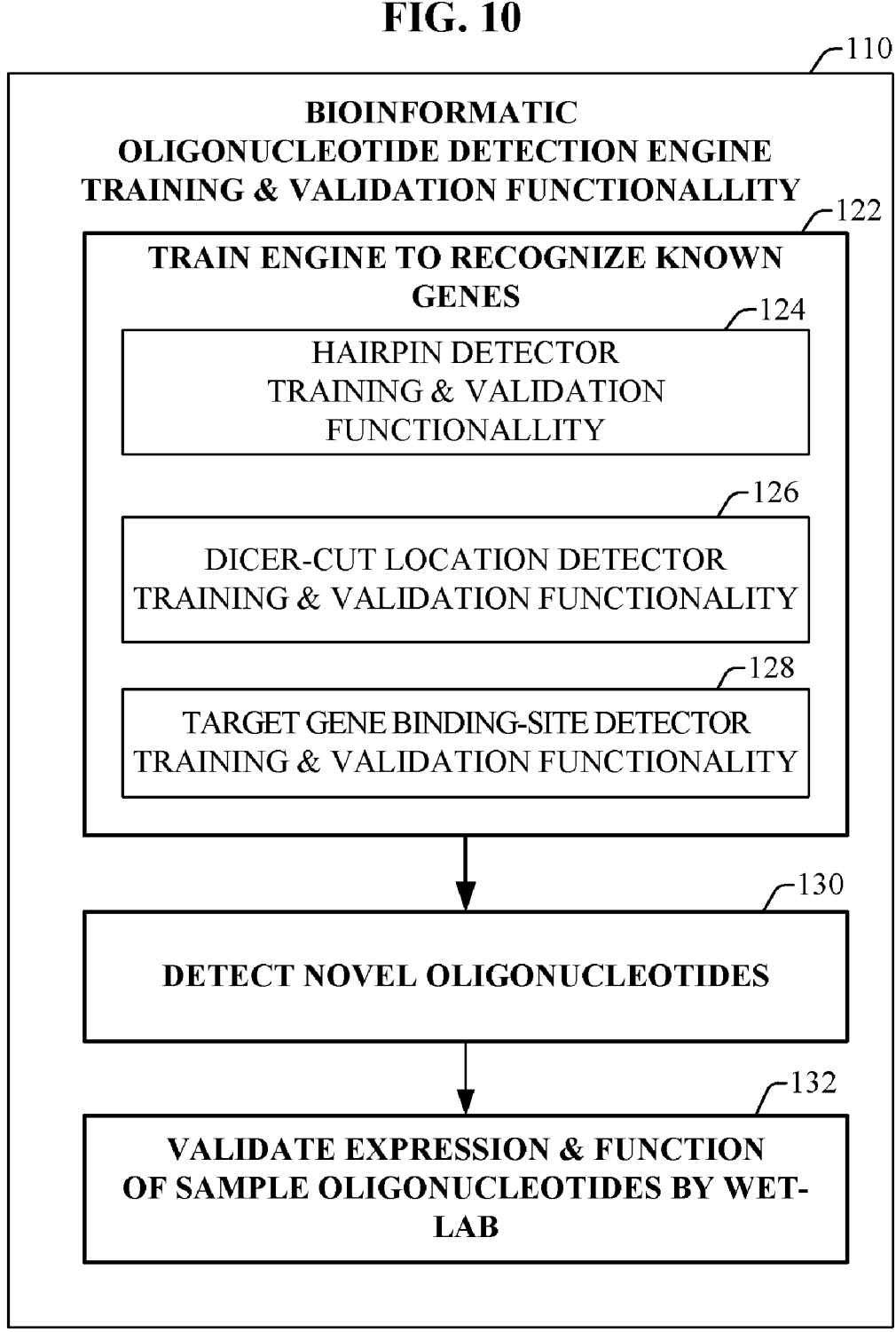
FIG. 10 is a simplified flowchart illustrating operation of a mechanism for training of a computer system to recognize the novel oligonucleotides of the present invention, which mechanism is constructed and operative in accordance with a preferred embodiment of the present invention.

Reference is now made to FIG. 10 which is a simplified flowchart illustrating operation of a preferred embodiment of the BIOINFORMATIC OLIGONUCLEOTIDE DETECTION ENGINE TRAINING & VALIDATION FUNCTIONALITY 110 described hereinabove with reference to FIG. 9.

BIOINFORMATIC OLIGONUCLEOTIDE DETECTION ENGINE TRAINING & VALIDATION FUNCTIONALITY 110 begins by training the BIOINFORMATIC OLIGONUCLEOTIDE DETECTION ENGINE 100 (FIG. 9) to recognize one or more known miRNA oligonucleotides, as designated by reference numeral 122. This training step comprises HAIRPIN DETECTOR TRAINING & VALIDATION FUNCTIONALITY 124, further described hereinbelow with reference to FIG. 12A, DICER-CUT LOCATION DETECTOR TRAINING & VALIDATION FUNCTIONALITY 126, further described hereinbelow with reference to FIGS. 13A and 13B, and TARGET GENE BINDING-SITE DETECTOR TRAINING & VALIDATION FUNCTIONALITY 128, further described hereinbelow with reference to FIG. 14A.

Next, the BIOINFORMATIC OLIGONUCLEOTIDE DETECTION ENGINE TRAINING & VALIDATION FUNCTIONALITY 110 is operative bioinformatically detect novel oligonucleotides, using BIOINFORMATIC OLIGONUCLEOTIDE DETECTION ENGINE 100 (FIG. 9), as designated by reference numeral 130. Wet lab experiments are preferably conducted in order to validate expression and preferably function of some samples of the novel oligonucleotides detected by the BIOINFORMATIC OLIGONUCLEOTIDE DETECTION ENGINE 100, as designated by reference numeral 132. FIGS. 22A-24D illustrate examples of wet-lab validation of the above mentioned sample novel oligonucleotides bioinformatically detected in accordance with a preferred embodiment of the present invention.

Figure 11A:
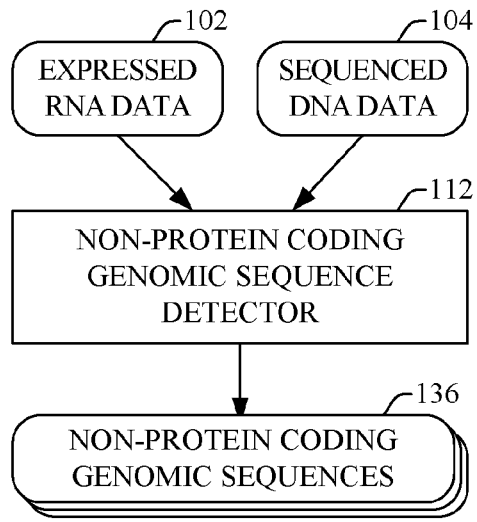
FIG. 11A is a simplified block diagram of a non-coding genomic sequence detector constructed and operative in accordance with a preferred embodiment of the present invention.
Figure 11B:
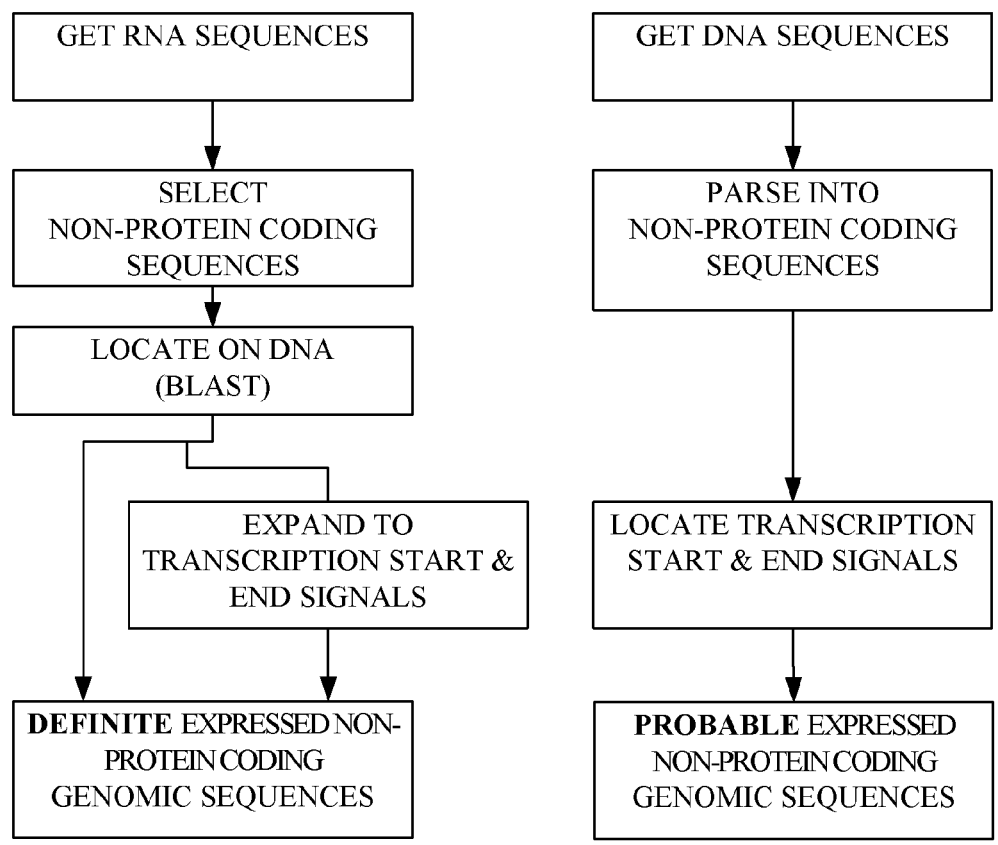
FIG. 11B is a simplified flowchart illustrating operation of a non-coding genomic sequence detector constructed and operative in accordance with a preferred embodiment of the present invention.

Reference is now made to FIG. 11A which is a simplified block diagram of a preferred implementation of the NON-CODING GENOMIC SEQUENCE DETECTOR 112 described hereinabove with reference to FIG. 9. The NON-PROTEIN CODING GENOMIC SEQUENCE DETECTOR 112 preferably receives at least two types of published genomic data: EXPRESSED RNA DATA 102 and SEQUENCED DNA DATA 104. The EXPRESSED RNA DATA 102 may include, inter alia, EST data, EST clusters data, EST genome alignment data and mRNA data. Sources for EXPRESSED RNA DATA 102 include NCBI dbEST, NCBI UniGene clusters and mapping data, and TIGR (Kirkness F. and Kerlavage, A. R., Methods Mol. Biol. 69:261-268 (1997)) gene indices. SEQUENCED DNA DATA 104 may include sequence data (FASTA format files), and feature annotations (GenBank file format) mainly from NCBI databases. Based on the above mentioned input data, the NON-PROTEIN CODING GENOMIC SEQUENCE DETECTOR 112 produces a plurality of NON-PROTEIN CODING GENOMIC SEQUENCES 136. Preferred operation of the NON-PROTEIN CODING GENOMIC SEQUENCE DETECTOR 112 is described hereinbelow with reference to FIG. 11B Reference is now made to FIG. 11B which is a simplified flowchart illustrating a preferred operation of the NONCODING GENOMIC SEQUENCE DETECTOR 112 of FIG. 9. Detection of NON-PROTEIN CODING GENOMIC SEQUENCES 136, generally preferably progresses along one of the following two paths:

A first path for detecting NON-PROTEIN CODING GENOMIC SEQUENCES 136 (FIG. 11A) begins with receipt of a plurality of known RNA sequences, such as EST data. Each RNA sequence is first compared with known protein-coding DNA sequences, in order to select only those RNA sequences which are non-protein coding, i.e. intergenic or intronic sequences. This can preferably be performed by using one of many alignment algorithms known in the art, such as BLAST (Altschul et al., J. Mol. Biol. 215:403-410 (1990)). This sequence comparison preferably also provides localization of the RNA sequence on the DNA sequences.

Alternatively, selection of non-protein coding RNA sequences and their localization on the DNA sequences can be performed by using publicly available EST cluster data and genomic mapping databases, such as the UNIGENE database published by NCBI or the TIGR database. Such databases, map expressed RNA sequences to DNA sequences encoding them, find the correct orientation of EST sequences, and indicate mapping of ESTs to protein coding DNA regions, as is well known in the art. Public databases, such as TIGR, may also be used to map an EST to a cluster of ESTs, known in the art as Tentative Human Consensus and assumed to be expressed as one segment. Publicly available genome annotation databases, such as NCBIs GenBank, may also be used to deduce expressed intronic sequences.

Optionally, an attempt may be made to "expand" the non-protein RNA sequences thus found, by searching for transcription start and end signals, respectively upstream and downstream of the location of the RNA on the DNA, as is well known in the art.

A second path for detecting NON-PROTEIN CODING GENOMIC SEQUENCES 136 (FIG. 11A) begins with receipt of DNA sequences. The DNA sequences are parsed into non protein coding sequences, using published DNA annotation data, by extracting those DNA sequences which are between known protein coding sequences. Next, transcription start and end signals are sought. If such signals are found, and depending on their robustness, probable expressed non-protein coding genomic sequences are obtained. Such approach is especially useful for identifying novel GAM oligonucleotides which are found in proximity to other known miRNA oligonucleotides, or other wet-lab validated GAM oligonucleotides. Since, as described hereinbelow with reference to FIG. 16, GAM oligonucleotides are frequently found in clusters, sequences located near known miRNA oligonucleotides are more likely to contain novel GAM oligonucleotides. Optionally, sequence orthology, i.e. sequence conservation in an evolutionary related species, may be used to select genomic sequences having a relatively high probability of containing expressed novel GAM oligonucleotides.

Figure 12A:
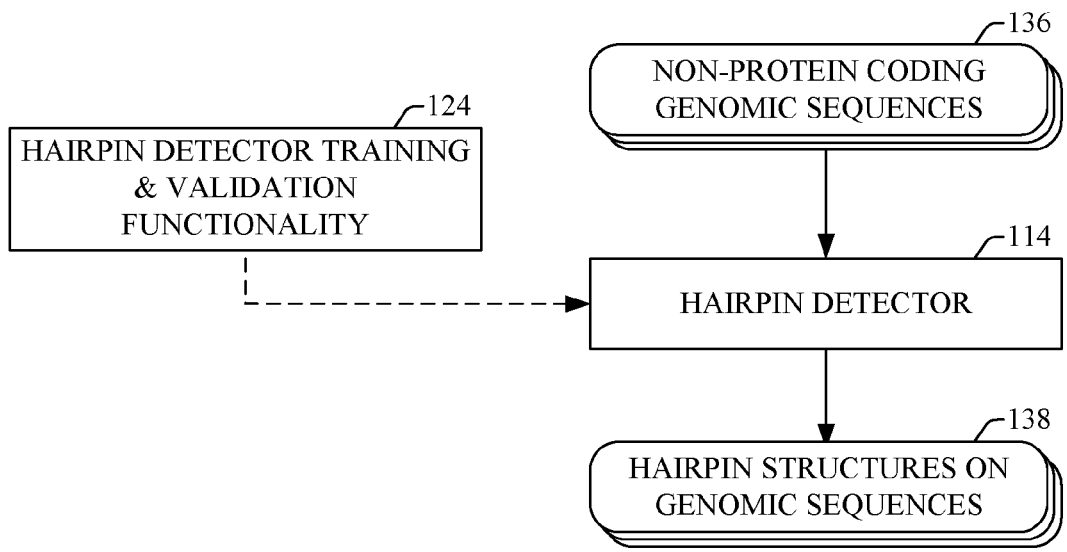
FIG. 12A is a simplified block diagram of a hairpin detector constructed and operative in accordance with a preferred embodiment of the present invention.

Reference is now made to FIG. 12A which is a simplified block diagram of a preferred implementation of the HAIRPIN DETECTOR 114 described hereinabove with reference to FIG. 9.

The goal of the HAIRPIN DETECTOR 114 is to detect hairpin-shaped genomic sequences, similar to those of known miRNA oligonucleotides. A hairpin-shaped genomic sequence is a genomic sequence, having a first half which is at least partially complementary to a second half thereof, which causes the halves to folds onto themselves, thereby forming a hairpin structure, as mentioned hereinabove with reference to FIG. 8.

The HAIRPIN DETECTOR 114 (FIG. 9) receives a plurality of NON-PROTEIN CODING GENOMIC SEQUENCES 136 (FIG. 11A). Following operation of HAIRPIN DETECTOR TRAINING & VALIDATION FUNCTIONALITY 124 (FIG. 10), the HAIRPIN DETECTOR 114 is operative to detect and output hairpin-shaped sequences, which are found in the NON-PROTEIN CODING GENOMIC SEQUENCES 136. The hairpin-shaped sequences detected by the HAIRPIN DETECTOR 114 are designated HAIRPINS STRUCTURES ON GENOMIC SEQUENCES 138. A preferred mode of operation of the HAIRPIN DETECTOR 114 is described hereinbelow with reference to FIG. 12B.

HAIRPIN DETECTOR TRAINING & VALIDATION FUNCTIONALITY 124 includes an iterative process of applying the HAIRPIN DETECTOR 114 to known hairpin shaped miRNA precursor sequences, calibrating the HAIRPIN DETECTOR 114 such that it identifies a training set of known hairpin-shaped miRNA precursor sequences, as well as other similarly hairpin-shaped sequences. In a preferred embodiment of the present invention, the HAIRPIN DETECTOR TRAINING & VALIDATION FUNCTIONALITY 124 trains the HAIRPIN DETECTOR 114 and validates each of the steps of operation thereof described hereinbelow with reference to FIG. 12B.

The HAIRPIN DETECTOR TRAINING & VALIDATION FUNCTIONALITY 124 preferably uses two sets of data: the aforesaid training set of known hairpin-shaped miRNA precursor sequences, such as hairpin-shaped miRNA precursor sequences of 440 miRNA oligonucleotides of *H. sapiens, M. musculus, C. elegans, C. Brigssae* and *D. Melanogaster*, annotated in the RFAM database (Griffiths-Jones, 2003), and a large background set of about 350,000 hairpin-shaped sequences found in expressed non-protein coding genomic sequences. The background set is expected to comprise some valid, previously undetected hairpin-shaped miRNA-like precursor sequences, and many hairpin-shaped sequences which are not hairpin-shaped miRNA-like precursors.

In order to validate the performance of the HAIRPIN DETECTOR 114 (FIG. 9), preferably a variation of the k-fold cross validation method (Tom M. Mitchell, Machine Learning, McGraw Hill (1997)), is employed. This preferred validation method is well adapted to deal with the training set, which includes large numbers of similar or identical miRNAs. The training set is therefore preferably initially divided into groups of miRNAs such that any two miRNAs that belong to different groups have an Edit Distance score of at least D=3, i.e. they differ by at least 3 editing steps (Dan Gusfield, Algorithms on strings, trees, and sequences: computer science and computational biology, Cambridge University Press, 1997). Next, the groups are preferably classified into k sets of groups. Standard k-fold cross validation is preferably performed on these sets, preferably using k=5, such that the training set and the test set include at least one sequence from each of the groups. It is appreciated that without the prior grouping, standard cross validation methods incorrectly indicate much higher performance results for the predictors due to the redundancy of training examples within the genome of a species and across genomes of different species.

In a preferred embodiment of the present invention, using the abovementioned validation methodology, the efficacy of the HAIRPIN DETECTOR 114 (FIG. 9) is confirmed. For example, when a similarity threshold is chosen such that 90% of the known hairpin-shaped miRNA precursors are successfully predicted, only 11% of the approximately 342,880 background set of hairpin-shaped sequences are predicted to be hairpin-shaped miRNA-like precursors.

Figure 12B:
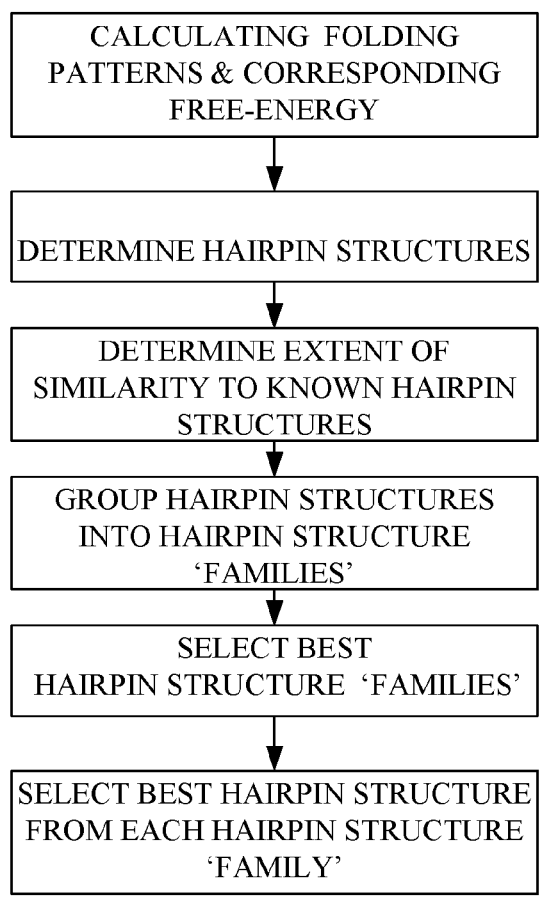
FIG. 12B is a simplified flowchart illustrating operation of a hairpin detector constructed and operative in accordance with a preferred embodiment of the present invention.

Reference is now made to FIG. 12B which is a simplified flowchart illustrating preferred operation of the HAIRPIN DETECTOR 114 of FIG. 9. The HAIRPIN DETECTOR 114 preferably initially uses a secondary structure folding algorithm based on free-energy minimization, such as the MFOLD algorithm, described in Mathews et al. J. Mol. Biol. 288:911-940 (1999) and Zuker, M. Nucleic Acids Res. 31: 3406-3415. (2003), the disclosure of which is hereby incorporated by reference. This algorithm is operative to calculate probable secondary structure folding patterns of the NON-PROTEIN CODING GENOMIC SEQUENCES 136 (FIG. 11A) as well as the free-energy of each of these probable secondary folding patterns. The secondary structure folding algorithm, such as the MFOLD algorithm (Mathews, 1997; Zuker 2003), typically provides a listing of the base-pairing of the folded shape, i.e. a listing of each pair of connected nucleotides in the sequence.

Next, the HAIRPIN DETECTOR 114 analyzes the results of the secondary structure folding patterns, in order to determine the presence and location of hairpin folding structures. The goal of this second step is to assess the base-pairing listing provided by the secondary structure folding algorithm, in order to determine whether the base-pairing listing describes one or more hairpin type bonding pattern. Preferably, sequence segment corresponding to a hairpin structure is then separately analyzed by the secondary structure folding algorithm in order to determine its exact folding pattern and free-energy.

The HAIRPIN DETECTOR 114 then assesses the hairpin structures found by the previous step, comparing them to hairpin structures of known miRNA precursors, using various characteristic hairpin structure features such as length of the hairpin structure, length of the loop of mismatched nucleotides at its center, its free-energy and its thermodynamic stability, the amount and type of mismatched nucleotides and the existence of sequence repeat-elements. Only hairpins that bear statistically significant resemblance to the training set of hairpin structures of known miRNA precursors, according to the abovementioned parameters, are accepted.

In a preferred embodiment of the present invention, similarity to the training set of hairpin structures of known miRNA precursors is determined using a "similarity score" which is calculated using a weighted sum of terms, where each term is a function of one of the abovementioned hairpin structure features. The parameters of each function are learned from the set of hairpin structures of known miRNA precursors, as described hereinabove with reference to HAIRPIN DETECTOR TRAINING & VALIDATION FUNCTIONALITY 124 (FIG. 10). The weight of each term in the similarity score is optimized so as to achieve maximized separation between the distribution peaks of similarity scores validated miRNA-precursor hairpin structures, and the distribution of similarity scores of hairpin structures detected in the background set mentioned hereinabove with reference to FIG. 12B.

In an alternative preferred embodiment of the present invention, the step described in the preceding paragraph may be split into two stages. A first stage implements a simplified scoring method, typically based on thresholding a subset of the hairpin structure features described hereinabove, and may employ a minimum threshold for hairpin structure length and a maximum threshold for free energy. A second stage is preferably more stringent, and preferably employs a full calculation of the weighted sum of terms described hereinabove. The second stage preferably is performed only on the subset of hairpin structures that survived the first stage.

The HAIRPIN DETECTOR 114 also attempts to select hairpin structures whose thermodynamic stability is similar to that of hairpin structures of known miRNA precursors. This may be achieved in various ways. A preferred embodiment of the present invention utilizes the following methodology, preferably comprising three logical steps:

First, the HAIRPIN DETECTOR 114 attempts to group hairpin structures into "families" of closely related hairpin structures. As is known in the art, a secondary structure folding algorithm typically provides multiple alternative folding patterns, for a given genomic sequence and indicates the free energy of each alternative folding pattern. It is a particular feature of the present invention that the HAIRPIN DETECTOR 114 preferably assesses the various hairpin structures appearing in the various alternative folding patterns and groups hairpin structures which appear at identical or similar sequence locations in various alternative folding patterns into common sequence location based "families" of hairpins. For example, all hairpin structures whose center is within 7 nucleotides of each other may be grouped into a family". Hairpin structures may also be grouped into a family" if their nucleotide sequences are identical or overlap to a predetermined degree.

It is also a particular feature of the present invention that the hairpin structure "families" are assessed in order to select only those families which represent hairpin structures that are as thermodynamically stable as those of hairpin structures of known miRNA precursors. Preferably only families which are represented in at least a selected majority of the alternative secondary structure folding patterns, typically 65%, 80% or 100% are considered to be sufficiently stable.

It is an additional particular feature of the present invention that the most suitable hairpin structure is selected from each selected family. For example, a hairpin structure which has the greatest similarity to the hairpin structures appearing in alternative folding patterns of the family may be preferred. Alternatively or additionally, the hairpin structures having relatively low free energy may be preferred.

Alternatively or additionally considerations of homology to hairpin structures of other organisms and the existence of clusters of thermodynamically stable hairpin structures located adjacent to each other along a sequence may be important in selection of hairpin structures. The tightness of the clusters in terms of their location and the occurrence of both homology and clusters may be of significance.

Figure 13A:
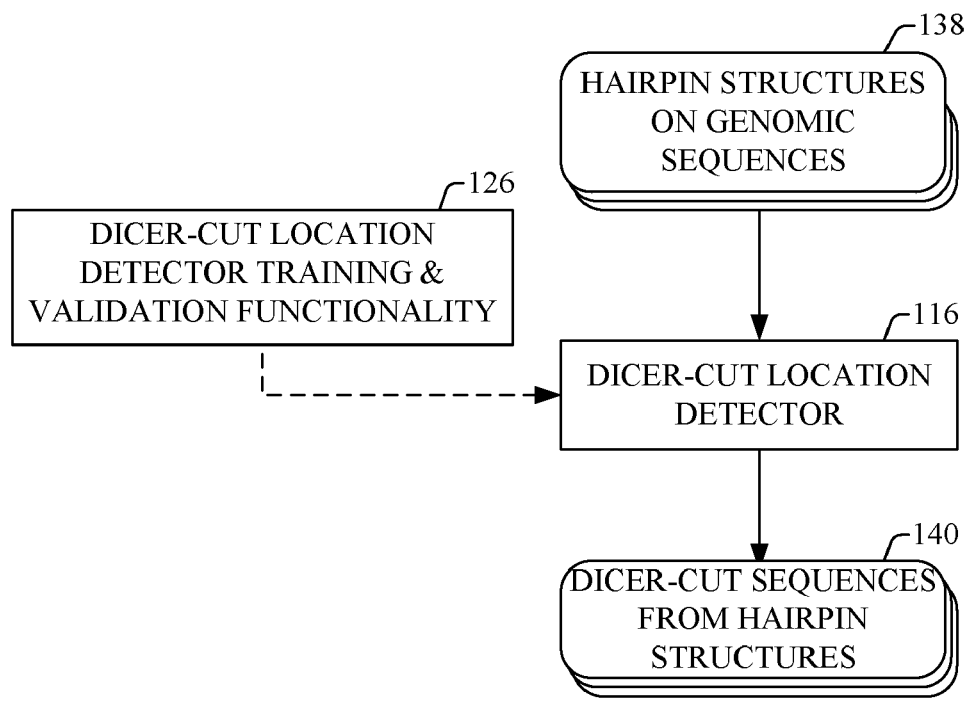
FIG. 13A is a simplified block diagram of a dicer-cut location detector constructed and operative in accordance with a preferred embodiment of the present invention.
Figure 13B:
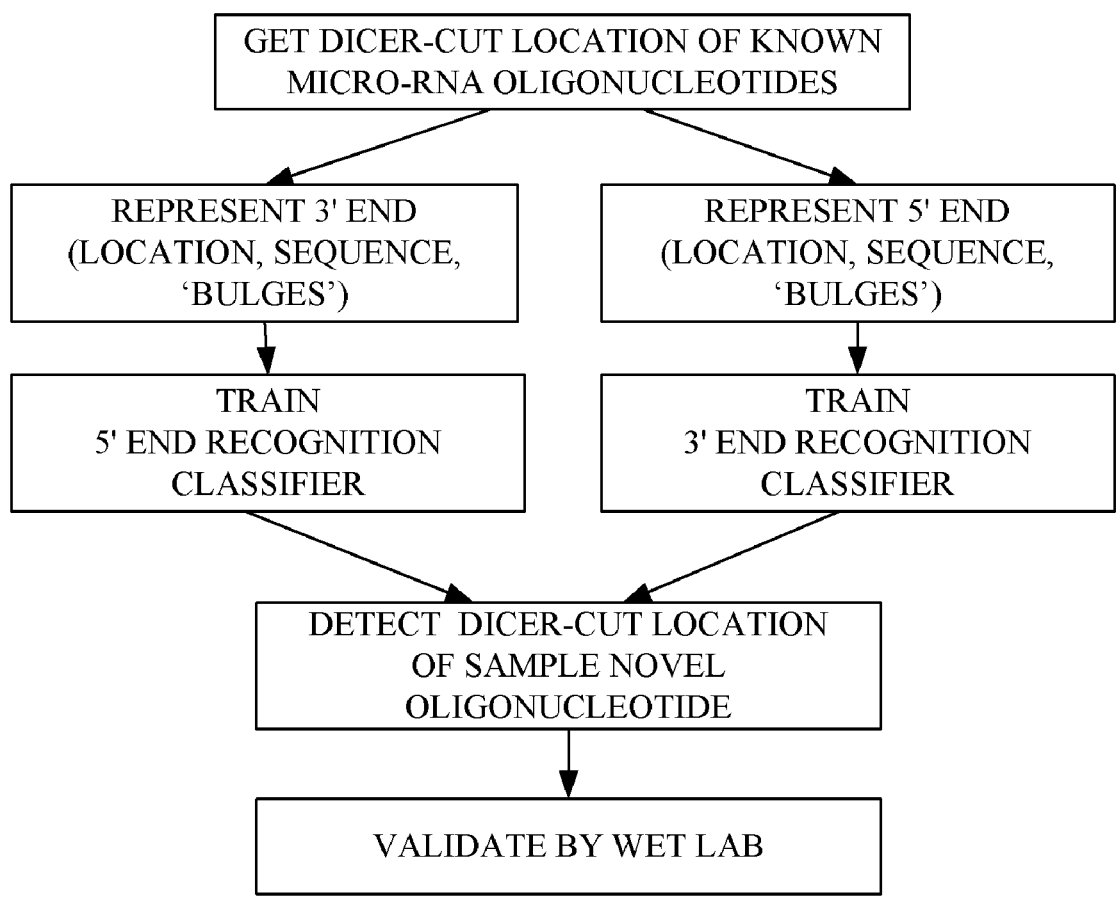
FIG. 13B is a simplified flowchart illustrating training of a dicer-cut location detector constructed and operative in accordance with a preferred embodiment of the present invention.
Figure 13C:
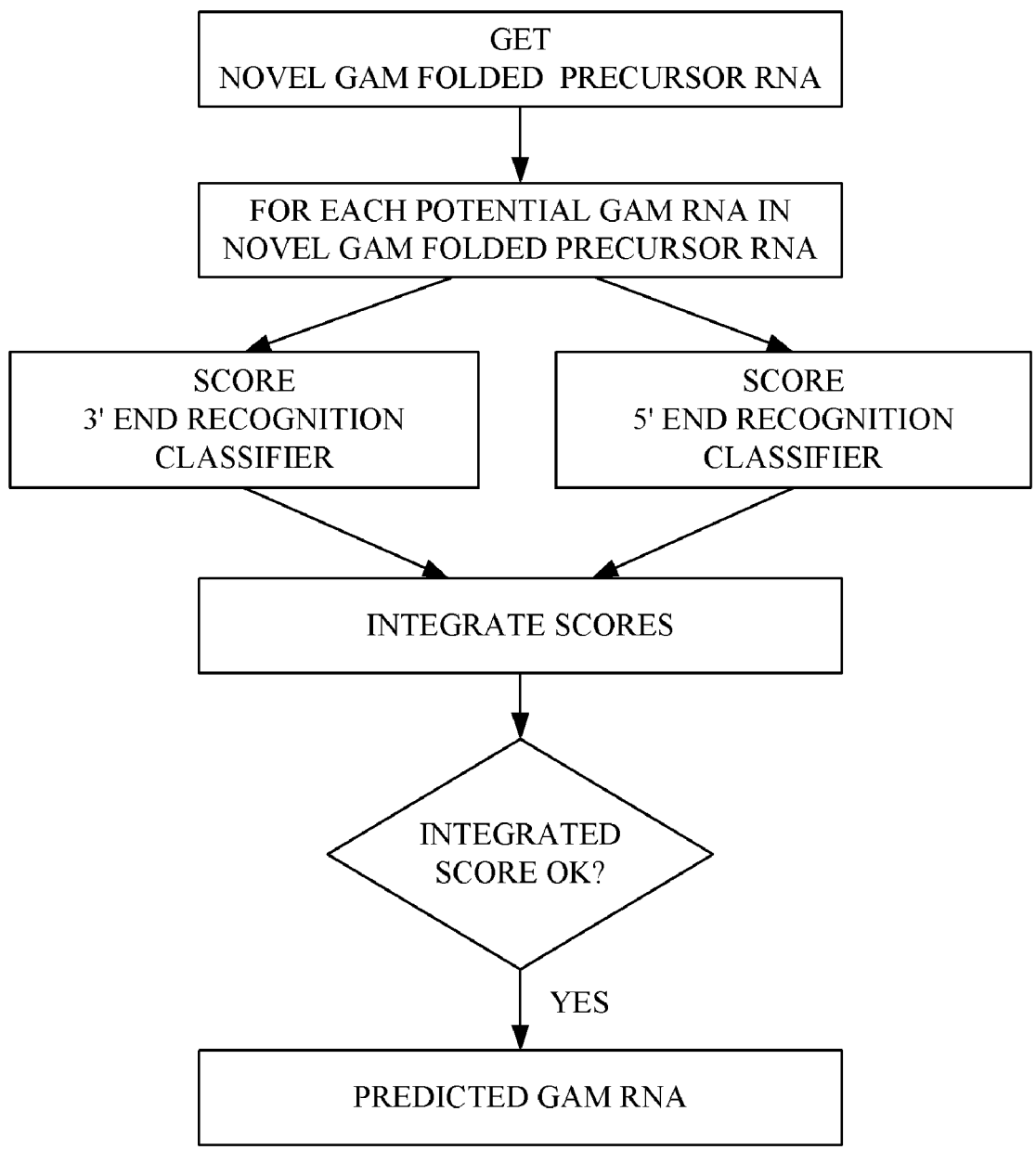
FIG. 13C is a simplified flowchart illustrating operation of a dicer-cut location detector constructed and operative in accordance with a preferred embodiment of the present invention.

Reference is now made to FIGS. 13A-13C which together describe the structure and operation of the DICER-CUT LOCATION DETECTOR 116, described hereinabove with FIG. 9.

FIG. 13A is a simplified block diagram of a preferred implementation 116. The goal of the DICER-CUT LOCATION DETECTOR 116 is to detect the location in which the DICER COMPLEX, described hereinabove with reference to FIG. 8, dices GAM FOLDED PRECURSOR RNA, yielding GAM RNA.

The DICER-CUT LOCATION DETECTOR 116 therefore receives a plurality of HAIRPIN STRUCTURES ON GENOMIC SEQUENCES 138 (FIG. 12A), and, following operation of DICER-CUT LOCATION DETECTOR TRAINING & VALIDATION FUNCTIONALITY 126 (FIG. 10), is operative to detect a plurality of DICER-CUT SEQUENCES FROM HAIRPIN STRUCTURES 140.

Reference is now made to FIG. 13B which is a simplified flowchart illustrating a preferred implementation of DICER-CUT LOCATION DETECTOR TRAINING & VALIDATION FUNCTIONALITY 126.

A general goal of the DICER-CUT LOCATION DETECTOR TRAINING & VALIDATION FUNCTIONALITY 126 is to analyze the dicer-cut locations of known diced miRNA on respective hairpin shaped miRNA precursors in order to determine a common pattern in these locations, which can be used to predict dicer cut locations on GAM folded precursor RNAs.

The dicer-cut locations of known miRNA precursors are obtained and studied. Locations of the 5' and/or 3' ends of the known diced miRNAs are preferably represented by their respective distances from the 5' end of the corresponding hairpin shaped miRNA precursor. Additionally or alternatively, the 5' and/or 3' ends of the known diced miRNAs are preferably represented by the relationship between their locations and the locations of one or more nucleotides along the hairpin shaped miRNA precursor. Additionally or alternatively, the 5' and/or 3' ends of the known diced miRNAs are preferably represented by the relationship between their locations and the locations of one or more bound nucleotide pairs along the hairpin shaped miRNA precursor. Additionally or alternatively, the 5' and/or 3' ends of the known diced miRNAs are preferably represented by the relationship between their locations and the locations of one or more mismatched nucleotide pairs along the hairpin shaped miRNA precursor. Additionally or alternatively, the 5' and/or 3' ends of the known diced miRNAs are preferably represented by the relationship between their locations and the locations of one or more unmatched nucleotides along the hairpin shaped miRNA precursor. Additionally or alternatively, locations of the 5' and/or 3' ends of the known diced miRNAs are preferably represented by their respective distances from the loop located at the center of the corresponding hairpin shaped miRNA precursor.

One or more of the foregoing location metrics may be employed in the training and validation functionality. Additionally, metrics related to the nucleotide content of the diced miRNA and/or of the hairpin shaped miRNA precursor may be employed.

In a preferred embodiment of the present invention, DICER-CUT LOCATION DETECTOR TRAINING & VALIDATION FUNCTIONALITY 126 preferably employs standard machine learning techniques known in the art of machine learning for analysis of existing patterns in a given "training set" of examples. These techniques are capable, to a certain degree, of detecting similar patterns in other, previously unseen examples. Such machine learning techniques include, but are not limited to neural networks, Bayesian networks, Support Vector Machines (SVM), Genetic Algorithms, Markovian modeling, Maximum Likelihood modeling, Nearest Neighbor algorithms, Decision trees and other techniques, as is well known in the art.

In accordance with one embodiment of the present invention, machine learning predictors, such as a Support Vector Machine (SVM) predictor, are applied to the aforementioned training set and are operative, for example to test every possible nucleotide on a hairpin as a candidate for being the 5' end or the 3' end of a diced GAM RNA. More preferred machine learning predictors include predictors based on Nearest Neighbor, Bayesian modeling, and K-nearest-neighbor algorithms. A training set of the known miRNA precursor sequences is preferably used for training multiple separate classifiers or predictors, each of which produces a model for the 5' and/or 3' end locations of a diced miRNA with respect to its hairpin precursor. The models take into account one or more of the various miRNA location metrics described above.

Performance of the resulting predictors, evaluated on the abovementioned validation set of 440 published miRNAs using k-fold cross validation (Mitchell, 1997) with k=3, is found to be as follows: in 70% of known miRNAs 5'-end location is correctly determined by an SVM predictor within up to 2 nucleotides; a Nearest Neighbor (EDIT DISTANCE) predictor achieves 56% accuracy (247/440); a Two-Phased predictor that uses Bayesian modeling (TWO PHASED) achieves 80% accuracy (352/440), when only the first phase is used. When the second phase (strand choice) is implemented by a nave Bayesian model the accuracy is 55% (244/440), and when the K-nearest-neighbor modeling is used for the second phase, 374/440 decision are made and the accuracy is 65% (242/374). A K-near-nearest-neighbor predictor (FIRST-K) achieves 61% accuracy (268/440). The accuracies of all predictors are considerably higher on top scoring subsets of published miRNA.

Finally, in order to validate the efficacy and accuracy of the DICER-CUT LOCATION DETECTOR 116, a sample of novel oligonucleotides detected thereby is preferably selected, and validated by wet lab. Laboratory results validating the efficacy of the DICER-CUT LOCATION DETECTOR 116 are described hereinbelow with reference to FIGS. 21-24D.

Reference is now made to FIG. 13C which is a simplified flowchart illustrating operation of DICER-CUT LOCATION DETECTOR 116 (FIG. 9), constructed and operative in accordance with a preferred embodiment of the present invention. The DICER CUT LOCATION DETECTOR 116 preferably comprises a machine learning computer program module, which is trained to recognize dicer-cut locations on known hairpin-shaped miRNA precursors, and based on this training, is operable to detect dicer-cut locations of novel GAM RNAs (FIG. 8) on GAM FOLDED PRECURSOR RNAs (FIG. 8). In a preferred embodiment of the present invention, the dicer-cut location module preferably utilizes machine learning algorithms, such as known Support Vector Machine (SVM) and more preferably: known Bayesian modeling, Nearest Neighbors, and K-nearest-neighbor algorithms.

When initially assessing a novel GAM FOLDED PRECURSOR RNA, all 19-24 nucleotide long segments thereof are initially considered as "potential GAM RNAs", since the dicer-cut location is initially unknown.

For each such potential GAM RNA, the location of its 5' end or the locations of its 5' and 3' ends are scored by at least one recognition classifier or predictor.

In a preferred embodiment of the present invention, the DICER-CUT LOCATION DETECTOR 116 (FIG. 9) may use a Support Vector Machine predictor trained on and operating on features such as the following:

Locations of the 5' and/or 3' ends of the known diced miRNAs, which are preferably represented by their respective distances from the 5' end of the corresponding hairpin shaped miRNA precursor. Additionally or alternatively, the 5' and/or 3' ends of the known diced miRNAs are preferably represented by the relationship between their locations and the locations of one or more nucleotides along the hairpin shaped miRNA precursor. Additionally or alternatively, the 5' and/or 3' ends of the known diced miRNAs are preferably represented by the relationship between their locations and the locations of one or more bound nucleotide pairs along the hairpin shaped miRNA precursor. Additionally or alternatively, the 5' and/or 3' ends of the known diced miRNAs are preferably represented by the relationship between their locations and the locations of one or more mismatched nucleotide pairs along the hairpin shaped miRNA precursor. Additionally or alternatively, the 5' and/or 3' ends of the known diced miRNAs are preferably represented by the relationship between their locations and the locations of one or more unmatched nucleotides along the hairpin shaped miRNA precursor. Additionally or alternatively, locations of the 5' and/or 3' ends of the known diced miRNAs are preferably represented by their respective distances from the loop located at the center of the corresponding hairpin shaped miRNA precursor; and secondarily Metrics related to the nucleotide content of the diced miRNA and/or of the hairpin shaped miRNA precursor.

In another preferred embodiment of the present invention, the DICER-CUT LOCATION DETECTOR 116 (FIG. 9) preferably employs an "EDIT DISTANCE" predictor, which seeks sequences that are similar to those of known miRNAs, utilizing a Nearest Neighbor algorithm, where a similarity metric between two sequences is a variant of the Edit Distance algorithm (Dan Gusfield, Algorithms on strings, trees, and sequences: computer science and computational biology, Cambridge University Press, 1997). The EDIT DISTANCE predictor is based on an observation that miRNA oligonucleotides tend to form clusters, the members of which show marked sequence similarity.

In yet another preferred embodiment of the present invention, the DICER-CUT LOCATION DETECTOR 116 (FIG. 9) preferably uses a "TWO PHASE" predictor, which predicts the dicer-cut location in two distinct phases: (a) selecting a double-stranded segment of the GAM FOLDED PRECURSOR RNA (FIG. 8) comprising the GAM RNA by nave Bayesian modeling and (b) detecting which strand of the double-stranded segment contains GAM RNA (FIG. 8) by employing either nave or by K-nearest-neighbor modeling. K-nearest-neighbor modeling is a variant of the 'FIRST-K' predictor described hereinbelow, with parameters optimized for this specific task. The 'TWO PHASE' predictor may be operated in two modes: either utilizing only the first phase and thereby producing two alternative dicer-cut location predictions, or utilizing both phases and thereby producing only one final dicer-cut location.

In still another preferred embodiment of the present invention, the DICER-CUT LOCATION DETECTOR 116 preferably uses a "FIRST-K" predictor, which utilizes a K-nearest-neighbor algorithm. The similarity metric between any two sequences is $1-E/L$, where L is a parameter, preferably 8-10 and E is the edit distance between the two sequences, taking into account only the first L nucleotides of each sequence. If the K-nearest-neighbor scores of two or more locations on the GAM FOLDED PRECURSOR RNA (FIG. 8) are not significantly different, these locations are further ranked by a Bayesian model, similar to the one described hereinabove.

The TWO PHASE and FIRST-K predictors preferably are trained on and operate on features such as the following:

Locations of the 5' and/or 3' ends of the known diced miRNAs, which are preferably represented by their respective distances from the 5' end of the corresponding hairpin shaped miRNA precursor. Additionally or alternatively, the 5' and/or 3' ends of the known diced miRNAs are preferably represented by the relationship between their locations and the locations of one or more nucleotides along the hairpin shaped miRNA precursor. Additionally or alternatively, the 5' and/or 3' ends of the known diced miRNAs are preferably represented by the relationship between their locations and the locations of one or more bound nucleotide pairs along the hairpin shaped miRNA precursor. Additionally or alternatively, the 5' and/or 3' ends of the known diced miRNAs are preferably represented by the relationship between their locations and the locations of one or more mismatched nucleotide pairs along the hairpin shaped miRNA precursor. Additionally or alternatively, the 5' and/or 3' ends of the known diced miRNAs are preferably represented by the relationship between their locations and the locations of one or more unmatched nucleotides along the hairpin shaped miRNA precursor. Additionally or alternatively, locations of the 5' and/or 3' ends of the known diced miRNAs are preferably represented by their respective distances from the loop located at the center of the corresponding hairpin shaped miRNA precursor; and secondarily Metrics related to the nucleotide content of the diced miRNA and/or of the hairpin shaped miRNA precursor.

In accordance with an embodiment of the present invention scores of two or more of the abovementioned classifiers or predictors are integrated, yielding an integrated score for each "potential GAM RNA". As an example, FIG. 13C illustrates integration of scores from two classifiers, a 3' end recognition classifier and a 5' end recognition classifier, the scores of which are integrated to yield an integrated score. Most preferably, the INTEGRATED SCORE of FIG. 13C preferably implements a "best-of-breed" approach employing a pair of classifiers and accepting only "potential GAM RNAs" that score highly on one of the above mentioned "EDIT DISTANCE", or "TWO-PHASE" predictors. In this context, "high scores" means scores which have been demonstrated to have low false positive value when scoring known miRNA oligonucleotides. Alternatively, the INTEGRATED SCORE may be derived from operation of more or less than two classifiers.

The INTEGRATED SCORE is evaluated as follows: (a) the "potential GAM RNA" having the highest score is preferably taken to be the most probable GAM RNA, and (b) if the integrated score of this most probable GAM RNA is higher than a pre-defined threshold, then the most probable GAM RNA is accepted as a PREDICTED GAM RNA. Preferably, this evaluation technique is not limited to the highest scoring potential GAM RNA.

Figure 14A:
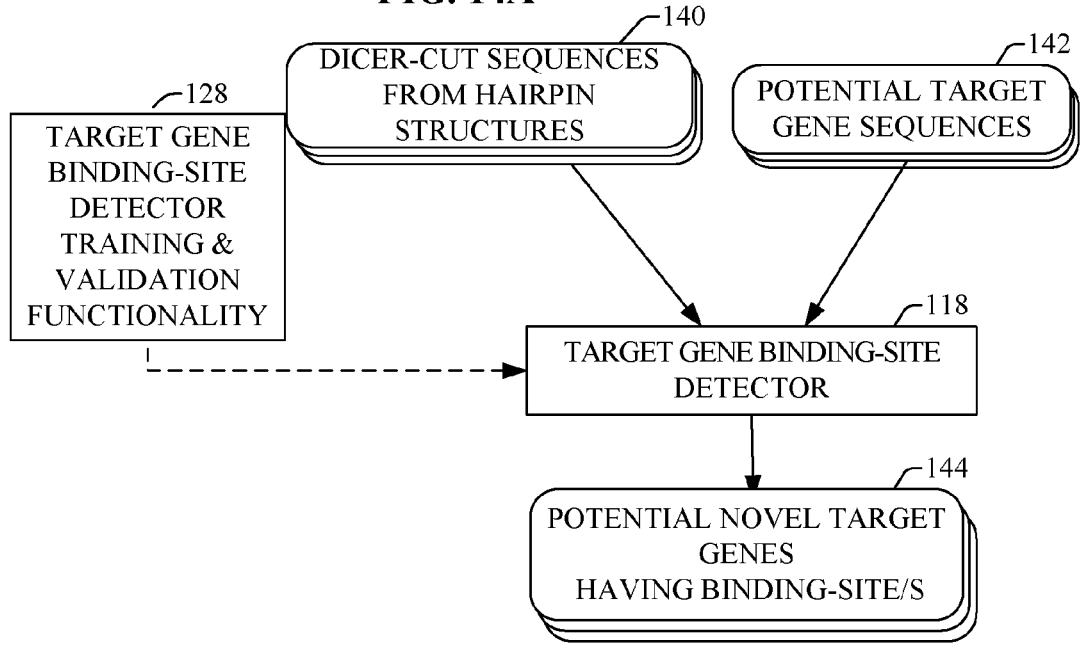
FIG. 14A is a simplified block diagram of a target gene binding-site detector constructed and operative in accordance with a preferred embodiment of the present invention.

Reference is now made to FIG. 14A which is a simplified block diagram of a preferred implementation of the TARGET GENE BINDING-SITE DETECTOR 118 described hereinabove with reference to FIG. 9. The goal of the TARGET GENE BINDING-SITE DETECTOR 118 is to detect one or more binding sites such as BINDING SITE I, BINDING SITE II and BINDING SITE III (FIG. 8) located in untranslated regions of the mRNA of a known gene, the nucleotide sequence of which binding sites is partially or fully complementary to a GAM RNA, thereby determining that the above mentioned known gene is a target gene thereof.

The TARGET GENE BINDING-SITE DETECTOR 118 (FIG. 9) receives a plurality of DICER-CUT SEQUENCES FROM HAIRPIN STRUCTURES 140 (FIG. 13A), and a plurality of POTENTIAL TARGET GENE SEQUENCES 142 which are derived from SEQUENCED DNA DATA 104 (FIG. 9).

TARGET GENE BINDING-SITE DETECTOR TRAINING & VALIDATION FUNCTIONALITY 128 (FIG. 10) is operative to train the TARGET GENE BINDING-SITE DETECTOR on known miRNAs and their respective target genes. A sequence comparison of sequences of known miRNA oligonucleotides to sequences of known binding sites of known target thereof is performed by utilizing BLAST or other algorithms such as EDIT DISTANCE.

The results are preferably employed to define a threshold based on scoring distinctions between known miRNA binding sites and sequences which are known not to be miRNA binding sites. This threshold is used during operation of TARGET GENE BINDING-SITE DETECTOR 118 to distinguish between miRNA-like binding sites of potential GAM RNA and other sequences.

Next, the binding sites are expanded, and determinations are made whether if nucleotide sequences immediately adjacent to the binding sites found by the sequence comparison algorithm (e.g. BLAST or EDIT DISTANCE), may improve the match. Free-energy and spatial structure are computed for the resulting binding sites. Binding sites which are clustered are strongly preferred and binding sites found in evolutionarily conserved sequences may also be preferred. Free energy, spatial structure and the above preferences are reflected in scoring.

The resulting scores, characteristic of known binding sites (e.g. binding sites of known miRNA oligonucleotides Lin-4 and Let-7 to target genes Lin-14, Lin-41, Lin 28 etc.), may be employed for detection of binding-sites of novel GAM RNAs.

Following operation of TARGET GENE BINDING-SITE DETECTOR TRAINING & VALIDATION FUNCTIONALITY 128 (FIG. 10), the TARGET GENE BINDING-SITE DETECTOR 118 is operative to detect a plurality of POTENTIAL NOVEL TARGET GENES HAVING BINDING-SITE/S 144 the nucleotide sequence of which is partially or fully complementary to that of each of the plurality of DICER-CUT SEQUENCES FROM HAIRPIN STRUCTURES 140. Preferred operation of the TARGET GENE BINDING-SITE DETECTOR 118 is further described hereinbelow with reference to FIG. 14B.

Figure 14B:
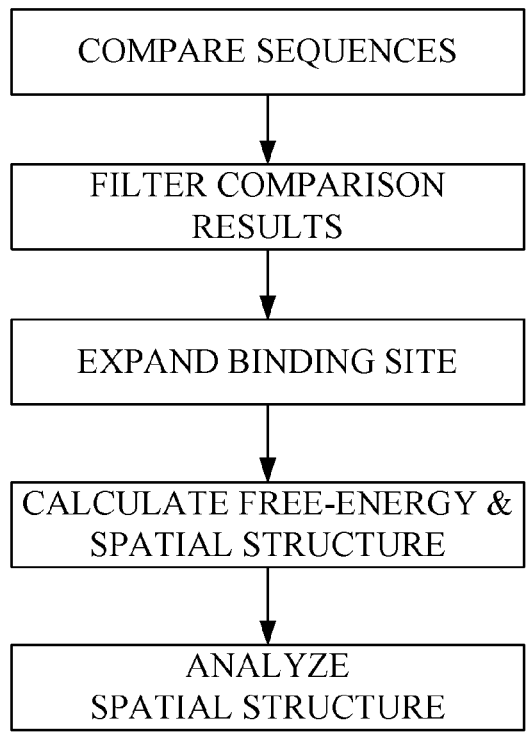
FIG. 14B is a simplified flowchart illustrating operation of a target gene binding-site detector constructed and operative in accordance with a preferred embodiment of the present invention.

Reference is now made to FIG. 14B which is a simplified flowchart illustrating a preferred operation of the TARGET GENE BINDING-SITE DETECTOR 118 of FIG. 9. In a preferred embodiment of the present invention, the TARGET GENE BINDING-SITE DETECTOR 118 employs a sequence comparison algorithm such as BLAST in order to compare the nucleotide sequence of each of the plurality of DICERCUT SEQUENCES FROM HAIRPIN STRUCTURES 140 (FIG. 13A), to the POTENTIAL TARGET GENE SEQUENCES 142 (FIG. 14A), such as untranslated regions of known mRNAs, in order to find crude potential matches. Alternatively, the sequence comparison may be performed using a sequence match search tool that is essentially a variant of the EDIT DISTANCE algorithm described hereinabove with reference to FIG. 13C, and the Nearest Neighbor algorithm.

A sequence comparison of DICER-CUT SEQUENCES FROM HAIRPIN STRUCTURES 140 (FIG. 14A) are compared to POTENTIAL TARGET GENE SEQUENCES 142 (FIG. 14A) by utilizing BLAST or other algorithms such as EDIT DISTANCE.

The results are preferably filtered according to a threshold determined in accordance with the scoring resulting from the sequence comparison carried out by the TARGET GENE BINDING-SITE DETECTOR TRAINING & VALIDATION FUNCTIONALITY 128.

Next the binding sites are expanded, and determinations are made whether if nucleotide sequences immediately adjacent to the binding sites found by the sequence comparison algorithm (e.g. BLAST or EDIT DISTANCE), may improve the match.

Free-energy and spatial structure are computed for the resulting binding sites. Binding sites which are clustered are strongly preferred and binding sites found in evolutionarily conserved sequences may also be preferred. Free energy, spatial structure and the above preferences are reflected in scoring.

The resulting scores are compared with scores characteristic of known binding sites (e.g. binding sites of known miRNA oligonucleotides Lin-4 and Let-7 to target genes Lin-14, Lin-41, Lin 28 etc.).

For each candidate binding site a score, here termed Binding Site Prediction Accuracy, is calculated which estimates its similarity to known binding sites. This score is based on GAM binding site characteristics including, but not limited to:

The free energy of binding of the GAM RNA-GAM RNA binding site complex;

Additionally or alternatively, the 5' and/or 3' ends of the GAM RNA, preferably represented by the relationship between their locations and the locations of one or more nucleotides along the GAM RNA; Additionally or alternatively, the 5' and/or 3' ends of the GAM RNA, preferably represented by the relationship between their locations and the locations of one or more bound nucleotide pairs along the GAM RNA binding site complex; Additionally or alternatively, the 5' and/or 3' ends of the GAM RNA, preferably represented by the relationship between their locations and the locations of one or more mismatched nucleotide pairs along the GAM RNA binding-site complex; Additionally or alternatively, the 5' and/or 3' ends of the GAM RNA, preferably represented by the relationship between their locations and the locations of one or more unmatched nucleotides along the GAM RNA binding-site complex.

In accordance with another preferred embodiment of the present invention, binding sites are searched by a reversed process. Sequences of K (preferably 22) nucleotides of a untranslated regions of a target gene are assessed as potential binding sites. A sequence comparison algorithm, such as BLAST or EDIT DISTANCE, is then used to search elsewhere in the genome for partially or fully complementary sequences which are found in known miRNA oligonucleotides or computationally predicted GAM oligonucleotides. Only complementary sequences, which meet predetermined spatial structure and free energy criteria as described hereinabove are accepted. Clustered binding sites are strongly preferred and potential binding sites and potential GAM oligonucleotides which occur in evolutionarily conserved genomic sequences are also preferred. Scoring of candidate binding sites takes into account free energy and spatial structure of the binding site complexes, as well as the aforesaid preferences.

Target binding sites identified by the TARGET GENE BINDING-SITE DETECTOR 118 (FIG. 9), are preferably divided into four groups:

a) binding sites which are exactly complementary to the predicted GAM RNA. (1 nt. mismatch is allowed)
b) binding sites which are not exactly complementary to the predicted GAM RNA and having 0.8=<Binding Site Prediction Accuracy<1;
c) binding sites which are not exactly complementary to the predicted GAM RNA and having 0.7=<Binding Site Prediction Accuracy<0.8; and
d) binding sites which are not exactly complementary to the predicted GAM RNA and having 0.6=<Binding Site Prediction Accuracy<0.7.

The average number of mismatched nucleotides in the alignment of predicted GAM RNA and a corresponding target gene binding-site is smallest in category a and largest in category d.

In accordance with a preferred embodiment of the present invention there is provided a binding site specific ranking, indicative of the degree of similarity of characteristics of the binding of a GAM to a target gene binding site, to binding characteristic of known miRNAs. This ranking preferably utilizes the evaluation criteria described hereinabove.

In accordance with another preferred embodiment of the present invention, there is provided a UTR specific ranking of GAM to target gene binding., indicative of the degree of similarity of characteristics of the binding of a GAM to a cluster of target gene binding sites on a UTR, to binding characteristics of known miRNAs to UTRs of corresponding miRNA target genes. This ranking preferably is a weighted sum of the binding site specific rankings of various clustered binding sites.

Figure 15:
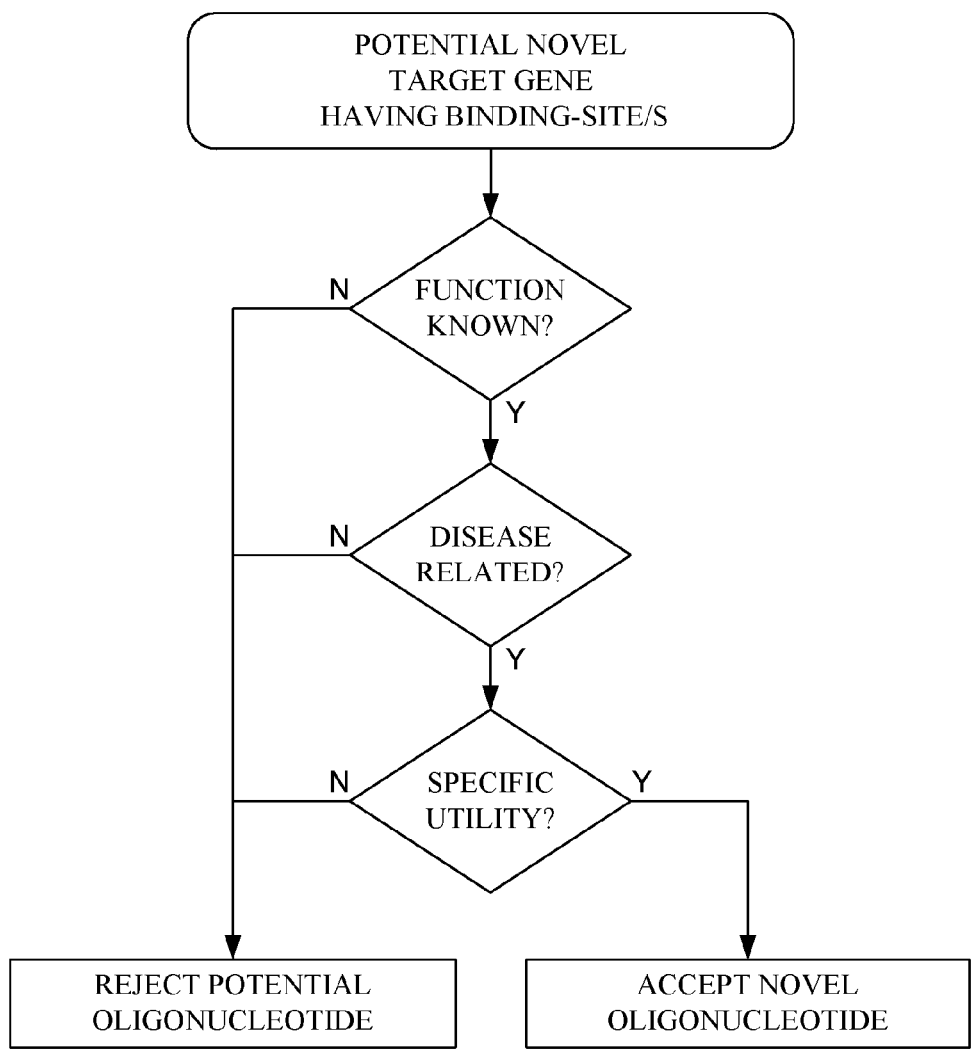
FIG. 15 is a simplified flowchart illustrating operation of a function & utility analyzer constructed and operative in accordance with a preferred embodiment of the present invention.

Reference is now made to FIG. 15 which is a simplified flowchart illustrating a preferred operation of the FUNCTION & UTILITY ANALYZER 120 described hereinabove with reference to FIG. 9. The goal of the FUNCTION & UTILITY ANALYZER 120 is to determine if a potential target gene is in fact a valid clinically useful target gene. Since a potential novel GAM oligonucleotide binding a binding site in the UTR of a target gene is understood to inhibit expression of that target gene, and if that target gene is shown to have a valid clinical utility, then in such a case it follows that the potential novel oligonucleotide itself also has a valid useful function which is the opposite of that of the target gene.

The FUNCTION & UTILITY ANALYZER 120 preferably receives as input a plurality of POTENTIAL NOVEL TARGET GENES HAVING BINDING-SITE/S 144 (FIG. 14A), generated by the TARGET GENE BINDING-SITE DETECTOR 118 (FIG. 9). Each potential oligonucleotide is evaluated as follows: First, the system checks to see if the function of the potential target gene is scientifically well established. Preferably, this can be achieved bioinformatically by searching various published data sources presenting information on known function of proteins. Many such data sources exist and are published as is well known in the art. Next, for those target genes the function of which is scientifically known and is well documented, the system then checks if scientific research data exists which links them to known diseases. For example, a preferred embodiment of the present invention utilizes the OMIM™ (Hamosh et al, 2002) database published by NCBI, which summarizes research publications relating to genes which have been shown to be associated with diseases. Finally, the specific possible utility of the target gene is evaluated. While this process too may be facilitated by bioinformatic means, it might require manual evaluation of published scientific research regarding the target gene, in order to determine the utility of the target gene to the diagnosis and or treatment of specific disease. Only potential novel oligonucleotides, the target genes of which have passed all three examinations, are accepted as novel oligonucleotide.

Figure 16:
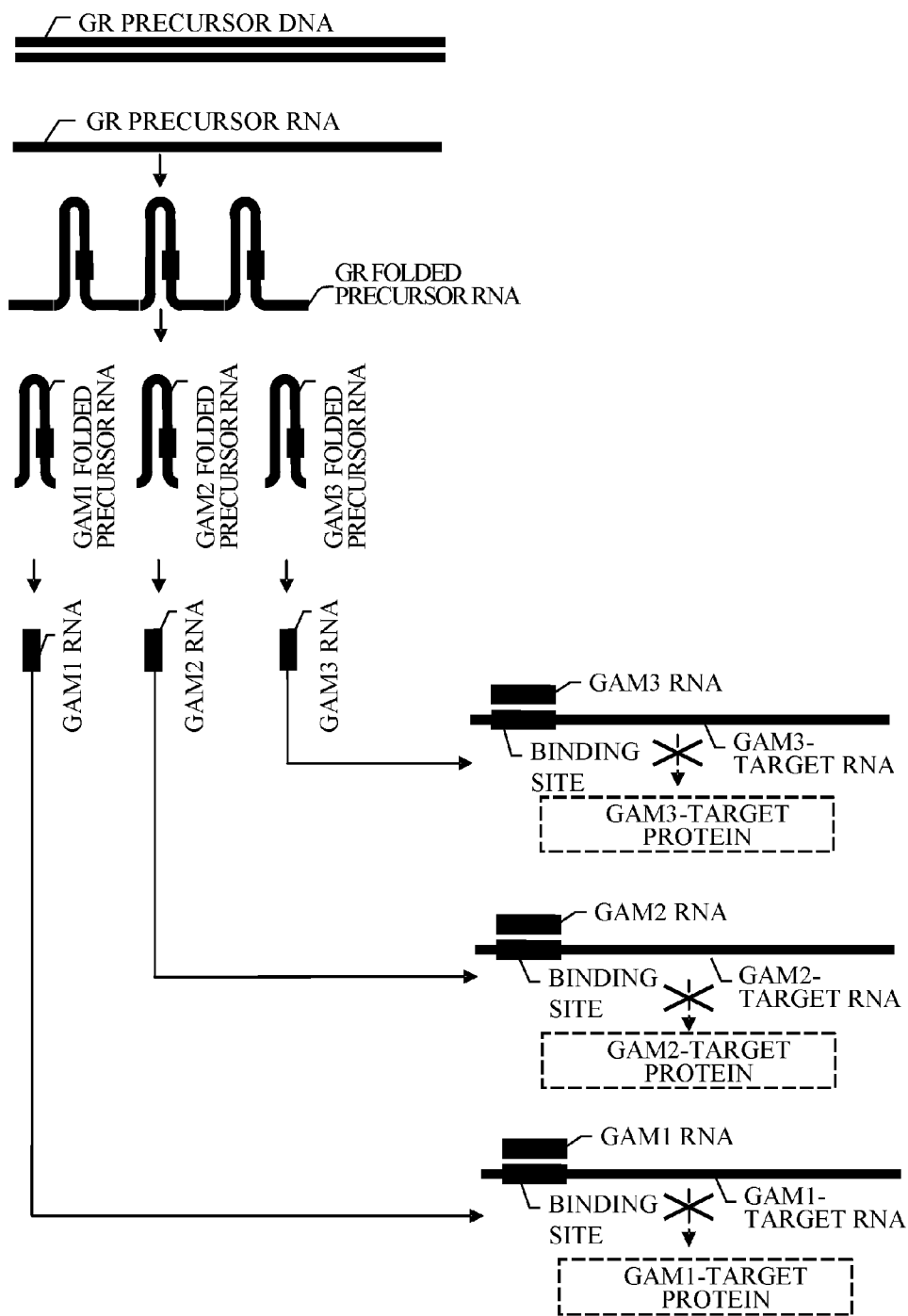
FIG. 16 is a simplified diagram describing a novel bioinformatically detected group of regulatory polynucleotides referred to here as Genomic Record (GR) polynucleotide, each of which encodes an 'operon-like' cluster of novel miRNA-like oligonucleotides, which in turn modulates expression of one or more target genes.

Reference is now made to FIG. 16, which is a simplified diagram describing each of a plurality of novel bioinformatically detected regulatory polynucleotide, referred to here as Genomic Record (GR) polynucleotide which encodes an 'operon-like' cluster of novel micro RNA-like oligonucleotides each of which in turn modulates expression of at least one target gene, the function and utility of which at least one target gene is known in the art. GR GPRECURSOR DNA is a novel bioinformatically detected regulatory, non protein coding, polynucleotide. The method by which GR polynucleotide as detected is described hereinabove with additional reference to FIGS. 9-18. GR GPRECURSOR DNA encodes GR PRECURSOR RNA, an RNA molecule, typically several hundreds to several thousands nucleotides long. GR PRECURSOR RNA folds spatially, forming GR FOLDED PRECURSOR RNA. It is appreciated that GR FOLDED PRECURSOR RNA comprises a plurality of what is known in the art as 'haipin' structures. These 'hairpin structures' are due to the fact that the nucleotide sequence of GR PRECURSOR RNA comprises a plurality of segments, the first half of each such segment having a nucleotide sequence which is at least a partial or accurate complementary sequence of the second half thereof, as is well known in the art. GR FOLDED PRECURSOR RNA is naturally processed by cellular enzymatic activity into separate GAM precursor RNAs, herein schematically represented by GAM1 FOLDED PRECURSOR RNA through GAM3 FOLDED PRECURSOR RNA, each of which GAM precursor RNAs being a hairpin shaped RNA segment, corresponding to GAM FOLDED PRECURSOR RNA of FIG. 8. The above mentioned GAM precursor RNAs are diced by DICER COMPLEX of FIG. 8, yielding respective short RNA segments of about 22 nucleotides in length, schematically represented by GAM1 RNA through GAM3 RNA, each of which GAM RNAs corresponding to GAM RNA of FIG. 8. GAM1 RNA, GAM2 RNA and GAM3 RNA, each bind complementarily to binding sites located in untranslated regions of respective target genes, designated GAM1-TARGET RNA, GAM2-TARGET RNA and GAM3-TARGET RNA, respectively, which target binding site corresponds to a target binding site such as BINDING SITE I, BINDING SITE II or BINDING SITE III of FIG. 8. This binding inhibits translation of the respective target proteins designated GAM1-TARGET PROTEIN, GAM2-TARGET PROTEIN and GAM3-TARGET PROTEIN respectively. It is appreciated that specific functions, and accordingly utilities, of each GR polynucleotides of the present invention, correlates with, and may be deduced from, the identity of the target genes, which are inhibited by GAM RNAs comprised in the 'operon-like' cluster of said GR polynucleotide schematically represented by GAM1 TARGET PROTEIN through GAM3 TARGET PROTEIN.

A listing of GAM oligonucleotide comprised in each of a plurality of GR polynucleotide of FIG. 16 is provided in Table 10, hereby incorporated herein. Nucleotide sequences of each said GAM oligonucleotide and their respective genomic source and chromosomal location are further described hereinbelow with reference to Table 3 hereby incorporated herein. GAM TARGET GENEs of each of said GAM oligonucleotides are elaborated hereinbelow with reference to Table 7, hereby incorporated herein. The functions of each of said GAM TARGET GENEs and their association with various diseases, and accordingly the utilities of said each of GAM oligonucleotides and hence the functions and utilities of each of said GR polynucleotides are elaborated hereinbelow with reference to Table 8, hereby incorporated herein. Studies establishing known functions of each of said GAM TARGET GENEs, and correlation of each of said GAM TARGET GENEs to known diseases are listed in Table 9, and are hereby incorporated herein.

The present invention discloses 246 novel genes of the GR group of polynucleotides, which have been detected bioinformatically. Laboratory confirmation of 2 polynucleotides of the GR group of polynucleotides is described hereinbelow with reference to FIGS. 23A-24D.

In summary, the current invention discloses a very large number of novel GR polynucleotides each of which encodes a plurality of GAM oligonucleotides, which in turn may modulate expression of a plurality of target proteins. It is appreciated therefore that the function of GR polynucleotides is in fact similar to that of the Genomic Records concept of the present invention addressing the differentiation enigma, described hereinabove with reference to FIG. 7.

Figure 17:
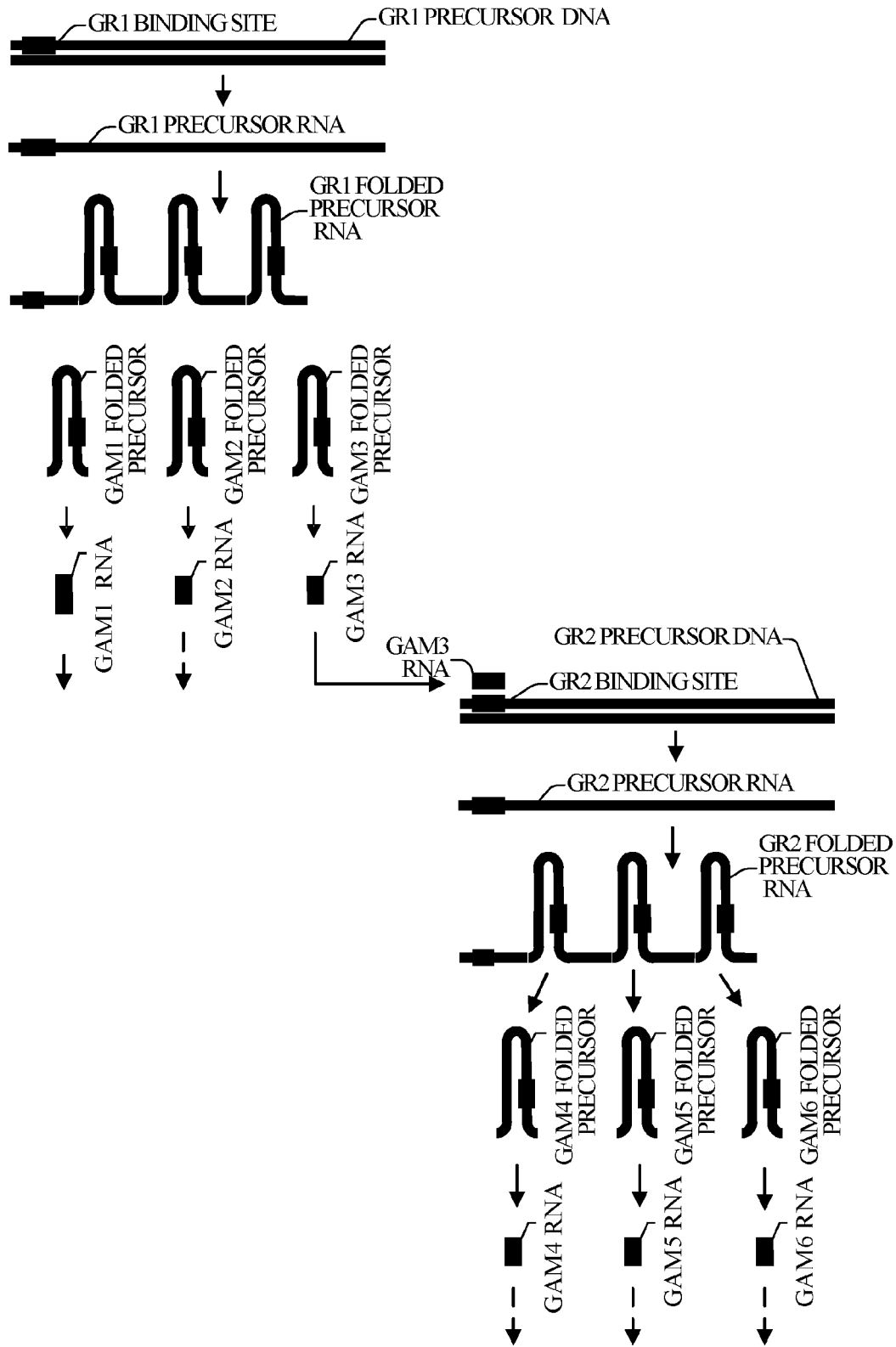
FIG. 17 is a simplified diagram illustrating a mode by which oligonucleotides of a novel group of operon-like polynucleotide of the present invention, modulate expression of other such polynucleotides, in a cascading manner.

Reference is now made to FIG. 17 which is a simplified diagram illustrating a mode by which oligonucleotides of a novel group of operon-like polynucleotide described hereinabove with reference to FIG. 16 of the present invention, modulate expression of other such polynucleotide, in a cascading manner. GR1 PRECURSOR DNA and GR2 PRECURSOR DNA are two polynucleotides of the novel group of operon-like polynucleotides designated GR PRECURSOR DNA (FIG. 16). As is typical of polynucleotides of the GR group of polynucleotides GR1 PRECURSOR DNA and GR2 PRECURSOR DNA, each encode a long RNA precursor, which in turn folds into a folded RNA precursor comprising multiple hairpin shapes, and is cut into respective separate hairpin shaped RNA segments, each of which RNA segments being diced to yield a n oligonucleotide of a group of oligonucleotide designated GAM RNA. In this manner GR1 yields GAM1 RNA, GAM2 RNA and GAM3 RNA, and GR2 yields GAM4 RNA, GAM5 RNA and GAM6 RNA. As FIG. 17 shows, GAM3 RNA, which derives from GR1, binds a binding site located adjacent to GR2 GPRECURSOR DNA thus modulating expression of GR2, thereby invoking expression of GAM4 RNA, GAM5 RNA and GAM6 RNA which derive from GR2. It is appreciated that the mode of modulation of expression presented by FIG. 17 enables an unlimited 'cascading effect' in which a GR polynucleotide comprises multiple GAM oligonucleotides each of which may modulate expression of other GR polynucleotides each such GR polynucleotides comprising additional GAM oligonucleotide etc., whereby eventually certain GAM oligonucleotides modulate expression of target proteins. This mechanism is in accord with the conceptual model of the present invention addressing the differentiation enigma, described hereinabove with specific reference to FIGS. 6-7.

Figure 18:
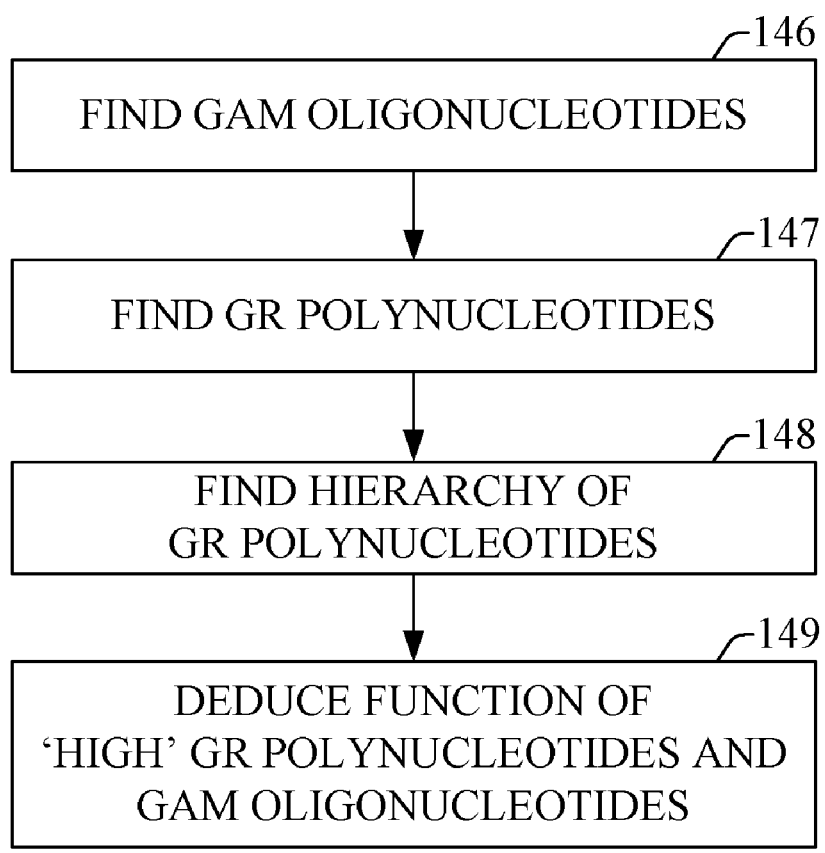
FIG. 18 is a block diagram illustrating an overview of a methodology for finding novel oligonucleotides and novel operon-like polynucleotides of the present invention, and their respective functions.

Reference is now made to FIG. 18 which is a block diagram illustrating an overview of a methodology for finding novel oligonucleotides and operon-like polynucleotides of the present invention, and their respective functions. According to a preferred embodiment of the present invention, the methodology to finding novel oligonucleotides of the present invention and their function comprises of the following major steps: First, FIND GAM OLIGONUCLEOTIDES 146 is used to detect, oligonucleotide of the novel group of oligonucleotide of the present invention, referred to here as GAM oligonucleotide. GAM oligonucleotides are located and their function elicited by detecting target proteins they bind and the function of those target proteins, as described hereinabove with reference to FIGS. 9-15. Next, FIND GR POLYNUCLEOTIDES 147 is used to detect polynucleotide of a novel group of operon-like polynucleotide of the present invention, referred to here as GR polynucleotide. GR polynucleotides are located, by locating clusters of proximally located GAM oligonucleotide, based on the previous step. Consequently, FIND HIERARCHY OF GR POLYNUCLEOTIDES 148 elicits the hierarchy of GR and GAM: binding sites for non-protein-binding GAM oligonucleotide comprised in each GR polynucleotide found are sought adjacent to other GR polynucleotides. When found, such a binding site indicates that the connection between the GAM and the GR the expression of which it modulates, and thus the hierarchy of the GR polynucleotides and the GAM oligonucleotides they comprise. Lastly, DEDUCE FUNCTION OF HIGH GR POLYNUCLEOTIDES AND GAM OLIGONUCLEOTIDES 149 is used to deduce the function of GR polynucleotides and GAM oligonucleotides which are 'high' in the hierarchy, i.e. GAM oligonucleotides which modulate expression of other GR polynucleotides rather than directly modulating expression of target proteins. A preferred approach is as follows: The function of protein-modulating GAM oligonucleotides is deducible from the proteins which they modulate, provided that the function of these target proteins is known. The function of 'higher' GAM oligonucleotides may be deduced by comparing the function of protein-modulating GAM oligonucleotides with the hierarchical relationships by which the 'higher' GAM oligonucleotides are connected to the protein-modulating GAM oligonucleotides. For example, given a group of several protein-modulating GAM oligonucleotides which collectively cause a protein expression pattern typical of a certain cell-type, then a 'higher' GAM oligonucleotide is sought which modulates expression of GR polynucleotides which perhaps modulate expression of other GR polynucleotides which eventually modulate expression of the given group of protein-modulating GAM oligonucleotide. The 'higher' GAM oligonucleotide found in this manner is taken to be responsible for differentiation of that cell-type, as per the conceptual model of the invention described hereinabove with reference to FIG. 6.

Figure 19:
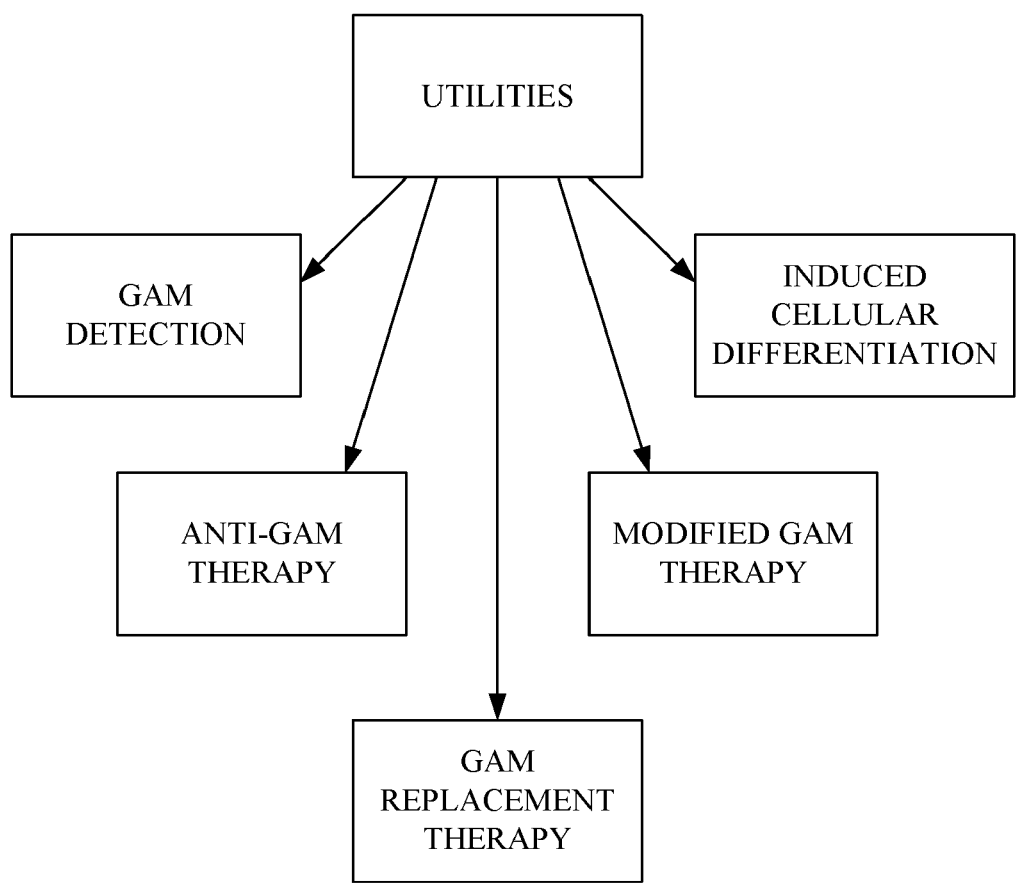
FIG. 19 is a block diagram illustrating different utilities of novel oligonucleotides and novel operon-like polynucleotides, both of the present invention.

Reference is now made to FIG. 19 which is a block diagram illustrating different utilities of oligonucleotide of the novel group of oligonucleotides of the present invention referred to here as GAM oligonucleotides and GR polynucleotides. The present invention discloses a first plurality of novel oligonucleotides referred to here as GAM oligonucleotides and a second plurality of operon-like polynucleotides referred to here as GR polynucleotides each of the GR polynucleotide encoding a plurality of GAM oligonucleotides The present invention further discloses a very large number of known target genes, which are bound by, and the expression of which is modulated by each of the novel oligonucleotides of the present invention. Published scientific data referenced by the present invention provides specific, substantial, and credible evidence that the above mentioned target genes modulated by novel oligonucleotides of the present invention, are associated with Alzheimers disease. Specific novel oligonucleotides of the present invention, target genes associated with Alzheimers diseases are described hereinbelow with reference to Tables 1 through 11. It is therefore appreciated that a function of GAM oligonucleotides and GR polynucleotides of the present invention is modulation of expression of target genes related to Alzheimers disease, and that therefore utilities of novel oligonucleotides of the present invention include diagnosis and treatment of Alzheimers disease. FIG. 19 describes various types of diagnostic and therapeutic utilities of novel oligonucleotides of the present invention. A utility of novel oligonucleotides of the present invention is detection of GAM oligonucleotides and of GR polynucleotides. It is appreciated that since GAM oligonucleotides and polynucleotides modulate expression of disease related target genes, that detection of expression of GAM oligonucleotides in clinical scenarios associated with said diseases is a specific, substantial and credible utility. Diagnosis of novel oligonucleotides of the present invention may preferably be implemented by RNA expression detection techniques, including but not limited to biochips, as is well known in the art. Diagnosis of expression of oligonucleotides of the present invention may be useful for research purposes, in order to further understand the connection between the novel oligonucleotides of the present invention and the Alzheimers disease, for disease diagnosis and prevention purposes, and for monitoring disease progress. Another utility of novel oligonucleotides of the present invention is anti-GAM therapy, a mode of therapy which allows up regulation of the disease related target gene of a novel GAM oligonucleotide of the present invention, by lowering levels of the novel GAM oligonucleotide which naturally inhibits expression of that target gene. This mode of therapy is particularly useful with respect to target genes which have been shown to be under-expressed in association with Alzheimers disease. Anti-GAM therapy is further discussed hereinbelow with reference to FIGS. 20A and 20B. A further utility of novel oligonucleotides of the present invention is GAM replacement therapy, a mode of therapy which achieves down regulation of Alzheimers related target gene of a novel GAM oligonucleotide of the present invention, by raising levels of the GAM which naturally inhibits expression of that target gene. This mode of therapy is particularly useful with respect to target genes which have been shown to be over-expressed in Alzheimers disease. GAM replacement therapy involves introduction of supplementary GAM products into a cell, or stimulation of a cell to produce excess GAM products. GAM replacement therapy may preferably be achieved by transfecting cells with an artificial DNA molecule encoding a GAM which causes the cells to produce the GAM product, as is well known in the art. Yet a further utility of novel oligonucleotides of the present invention is modified GAM therapy. Disease conditions are likely to exist, in which a mutation in a binding site of a GAM RNA prevents natural GAM RNA to effectively bind inhibit a disease related target gene, causing up regulation of that target gene, and thereby contributing to the disease pathology. In such conditions, a modified GAM oligonucleotides is designed which effectively binds the mutated GAM binding site, i.e. is an effective anti-sense of the mutated GAM binding site, and is introduced in disease effected cells. Modified GAM therapy is preferably achieved by transfecting cells with an artificial DNA molecule encoding the modified GAM which causes the cells to produce the modified GAM product, as is well known in the art. An additional utility of novel GAM of the present invention is induced cellular differentiation therapy. As aspect of the present invention is finding oligonucleotides which determine cellular differentiation, as described hereinabove with reference to FIG. 18. Induced cellular differentiation therapy comprises transfection of cell with such GAM oligonucleotides thereby determining their differentiation as desired. It is appreciated that this approach may be widely applicable, inter alia as a means for auto transplantation harvesting cells of one cell-type from a patient, modifying their differentiation as desired, and then transplanting them back into the patient. It is further appreciated that this approach may also be utilized to modify cell differentiation in vivo, by transfecting cells in a genetically diseased tissue with a cell-differentiation determining GAM thus stimulating these cells to differentiate appropriately.

Figure 20A:
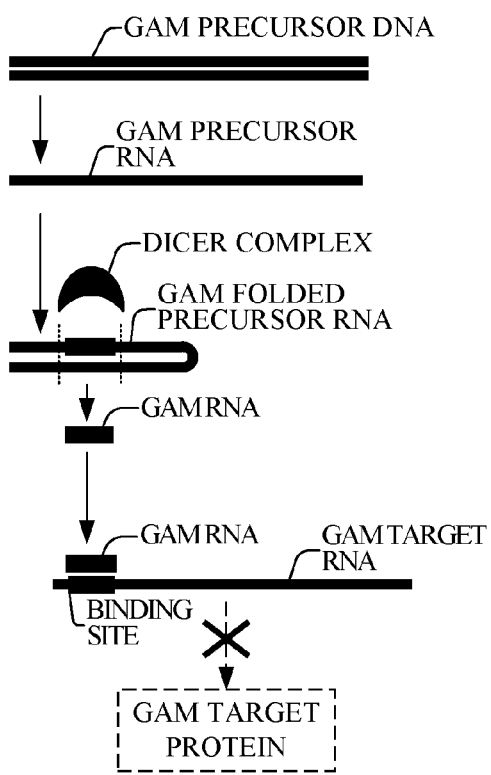
FIGS. 20A and 20B are simplified diagrams, which when taken together illustrate a mode of oligonucleotide-therapy applicable to novel oligonucleotides of the present invention.
Figure 20B:
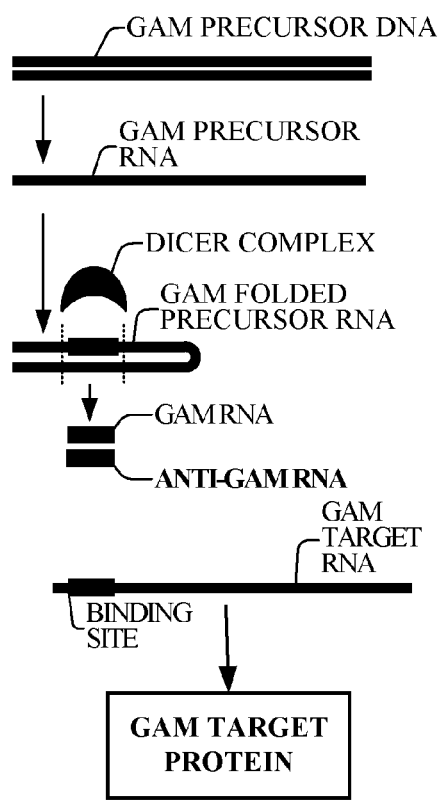

Reference is now made to FIGS. 20A and 20B, simplified diagrams which when taken together illustrate anti-GAM therapy mentioned hereinabove with reference to FIG. 19. A utility of novel GAMs of the present invention is anti-GAM therapy, a mode of therapy which allows up regulation of Alzheimers disease related target gene of a novel GAM of the present invention, by lowering levels of the novel GAM which naturally inhibits expression of that target gene. FIG. 20A shows a normal GAM inhibiting translation of a target gene of GAM RNA by binding to a BINDING SITE found in an untranslated region of GAM TARGET RNA, as described hereinabove with reference to FIG. 8.

FIG. 20B shows an example of anti-GAM therapy. ANTI-GAM RNA is short artificial RNA molecule the sequence of which is an anti-sense of GAM RNA. Anti-GAM treatment comprises transfecting diseased cells with ANTI-GAM RNA, or with a DNA encoding thereof. The ANTI-GAM RNA binds the natural GAM RNA, thereby preventing binding of natural GAM RNA to its BINDING SITE. This prevents natural translation inhibition of GAM TARGET RNA by GAM RNA, thereby up regulating expression of GAM TARGET PROTEIN.

It is appreciated that anti-GAM therapy is particularly useful with respect to target genes which have been shown to be under-expressed in Alzheimers disease. Furthermore, anti-GAM therapy is particularly useful, since it may be used in situations in which technologies known in the art as RNAi and siRNA can not be utilized. As in known in the art, RNAi and siRNA are technologies which offer means for artificially inhibiting expression of a target protein, by artificially designed short RNA segments which bind complementarily to mRNA of said target protein. However, RNAi and siRNA can not be used to directly up regulate translation of target proteins.

Figure 21A:
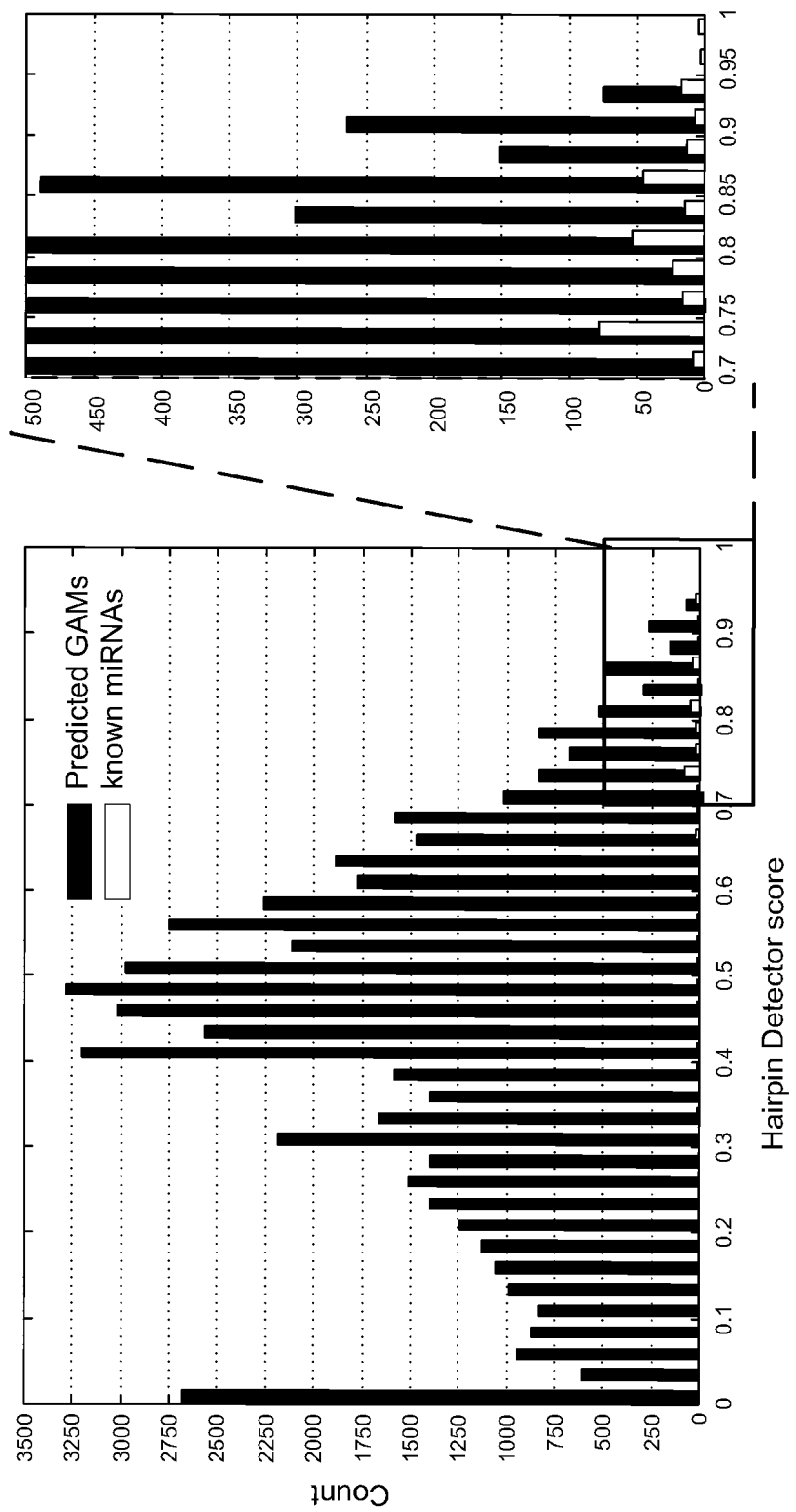
FIG. 21A is a histogram representing the distribution of known miRNA oligonucleotides, and that of miRNA-like hairpin-shaped oligonucleotides, predicted by the bioinformatics detection engine of the present invention, extracted from expressed genome sequences with respect to their hairpin detector score.

Reference is now made to FIG. 21A, which is a histogram representing the distribution of known miRNA oligonucleotides and that of hairpin structures extracted from expressed genome sequences with respect to their HAIRPIN DETECTOR score. The known miRNA oligonucleotide s set is taken from RFAM database, Release 2.1 and include 440 miRNA oligonucleotides from *H. sapienas, M. musculus, C. elegans, C. brigassae* and *D. melanogaster*. Folding of expressed genome sequences taken from public databases of ESTs (Unigene-NCBI and TIGR) identified 342,882 hairpin structures. ~154,000 out of the 342,882 hairpin structures did not pass the filter of being identified as hairpins in several secondary structure folding versions of the given genomic sequence, as described hereinabove with reference to FIG. 12B, and hence did not receive a Hairpin detector score. Furthermore, ~133,000 hairpin structures did not pass the filter of minimum score of the DICER-CUT LOCATION DETECTOR 116 (FIG. 9) (those ~287,000 hairpin structures are not represented in the histogram). Hairpin structures are considered as miRNA-like precursor oligonucleotides here referred to as GAM oligonucleotide, if their Hairpin detector score is above 0.3. Thus, the GAM oligonucleotides set is comprised of 40,000 hairpin structures, of those ~5100 received a high Hairpin detector score (>=0.7). These are much higher numbers than those of the known miRNA oligonucleotides and of the upper bound of ~255 human miRNA oligonucleotide s, estimated by Bartel et al (Science, 299, 1540, March 2003). Of the reference set that pass the above filter (408/440), 284 (69%) received a high Hairpin detector score (>=0.7).

Reference is now made to FIG. 21B, which is a table summarizing laboratory validation results that validate efficacy of the BIOINFORMATIC OLIGONUCLEOTIDE DETECTION ENGINE 100 (FIG. 9). In order to assess efficacy of the BIOINFORMATIC OLIGONUCLEOTIDE DETECTION ENGINE 100, novel oligonucleotides predicted thereby are preferably divided into 4 detection accuracy groups (first column), designated A through D, ranking GAMS from the most probable GAMs to the least probable GAMs, using the scores of HAIRPIN DETECTOR 114 (FIG. 9) and DICER-CUT LOCATION DETECTOR 116 (FIG. 9) as follows:

Group A: The score of the HAIRPIN-DETECTOR is above 0.7, the overall score of the two-phased predictor is above 0.55, and the score of the second phase of the two-phased predictor is above 0.75, or the score of the EDIT-DISTANCE predictor is equal or above 17. In this group, one Dicer cut location is predicted for each hairpin. Group B: The score of the HAIRPIN-DETECTOR is above 0.5, the overall score of the two-phased predictor is above 0.55, and the hairpin is not in group A. Group C: The score of the HAIRPIN-DETECTOR is between 0.4 and 0.5, and the overall score of the two-phased predictor is above 0.55. Group D: The score of the HAIRPIN-DETECTOR is between 0.3 and 0.4, and the overall score of the two-phased predictor is above 0.55. In groups B, C and D, if the score of the second phase of the two-phased predictor is above 0.75, one Dicer cut location is predicted for each hairpin, otherwise both sides of the double stranded window are given as output, and are examined in the lab or used for binding site search. The groups are mutually exclusive, i.e. in groups A, C and D all hairpins score less than 17 in the EDIT-DISTANCE predictor.

It is appreciated that the division into groups is not exhaustive: 410 of the 440 published hairpins (second column), and 1419 of the 1708 novel GAMs, belong to one of the groups. An indication of the real performance of the two-phased predictor in the presence of background hairpins is given by the column 'precision on hairpin mixture' (third column). The precision on hairpin mixture is computed by mixing the published miRNA hairpins with background hairpins in a ratio of 1:4 and taking as a working assumption that they are hairpins not carrying a 'diced' miRNA-like oligonucleotide This is a strict assumption, since some of these background hairpins may indeed contain 'diced' miRNAs-like oligonucleotide, while in this column they are all counted as failures Sample novel bioinformatically predicted human GAMs of each of these groups are sent to the laboratory for validation (fourth column), and the number (fifth column) and percent (sixth column) of successful validation of predicted human GAM is noted for each of the groups, as well as overall (bottom line). The number of novel VAM genes explicitly specified by present invention belonging to each of the four groups is noted (seventh column).

It is appreciated that the present invention comprises 1419 novel GAM oligonucleotides, which fall into one of these four detection accuracy groups, and that the BIOINFORMATIC OLIGONUCLEOTIDE DETECTION ENGINE 100 (FIG. 9) is substantiated by a group of 52 novel human GAM oligonucleotides validated by laboratory means, out of 168 human GAM oligonucleotides which were tested in the lab, resulting in validation of an overall 31% accuracy. The top group demonstrated 37% accuracy. Pictures of test-results of specific human GAM oligonucleotides in the abovementioned four groups, as well as the methodology used for validating the expression of predicted oligonucleotides are elaborated hereinbelow with reference to FIG. 22.

It is further appreciated that failure to detect a predicted GAM oligonucleotide in the lab does not necessarily indicate a mistaken bioinformatic prediction. Rather, it may be due to technical sensitivity limitation of the lab test, or because the GAM oligonucleotides not expressed in the tissue examined, or at the development phase tested.

It is still further appreciated that in general these findings are in agreement with the expected bioinformatic accuracy, as describe hereinabove with reference to FIG. 13B: assuming 80% accuracy of the HAIRPIN DETECTOR 114 and 80% accuracy of the DICER-CUT LOCATION DETECTOR 116 and 80% accuracy of the lab validation, this would result in 50% overall accuracy of the GAM oligonucleotide validated in the lab.

Figure 22A:

Reference is now made to FIG. 22A which is a picture of laboratory results validating the expression of 43 novel genes detected by the BIOINFORMATIC OLIGONUCLEOTIDE DETECTION ENGINE 100 (FIG. 9).

Reference is now made to FIG. 22A and FIG. 22B which are pictures and a summary table of laboratory results validating the expression of 43 novel human GAM oligonucleotides detected by the BIOINFORMATIC OLIGONUCLEOTIDE DETECTION ENGINE 100. In each row in FIG. 22A, pictures of several oligonucleotides validated by hybridization of Polymerase Chain Reaction (PCR)-product southern-blots, are provided, each corresponding to a specific GAM oligonucleotides, as elaborated hereinbelow. To test our validation method, we used a reference set of 8 known human miRNA oligonucleotides, as blind test to our laboratory. These PCR-product hybridization pictures are designated 1 through 8 for the reference set known miRNA oligonucleotides; and 9 through 51 for predicted GAM oligonucleotides.

In each PCR hybridization picture, 2 lanes are seen: the test lane, designated "+" and the control lane, designated "−". For convenience of viewing the results, all PCR-product hybridization pictures of FIG. 22A have been shrunk ×4 vertically. It is appreciated that for each of the tested GAM oligonucleotides a clear hybridization band appears in the test ("+") lane, but not in the control ("−") lane.

Specifically, FIG. 22A shows pictures of PCR-product hybridization validation by southern-blot, the methodology of which is described hereinbelow, to the following novel human GAM oligonucleotides (RosettaGenomics Ltd. Nomenclature, 'A' and 'B' referred to the Dicer Cut Location as described hereinabove with reference to the description of large tables:

(1) hsa-MIR-21; (2) hsa-MIR-27b; (3) hsa-MIR-186; (4) hsa-MIR-93; (5) hsa-MIR-26a; (6) hsa-MIR-191; (7) hsa-MIR-31; (8) hsa-MIR-92; (9) GAM3418-A (later published by other researchers as hsa-MIR23); (10) GAM4426-A; (11) GAM281-A; (12) GAM7553-A; (13) GAM5385-A; (14) GAM2608-A; (15) GAM1032-A; (16) GAM3431-A; (17) GAM7933-A; (18) GAM3298-A; (19) GAM7080-A; (20) GAM895-A; (21) GAM3770.1; (22) GAM337162-A; (23) GAM8678-A; (24) GAM2033-A; (25) GAM7776-A; (26) GAM8145-A; (27) GAM25-A; (28) GAM7352.1; (29) GAM337624-A; (30) GAM1479-A; (31) GAM2270-A; (32) GAM7591-A; (33) GAM8285-A; (34) GAM6773-A; (35) GAM336818-A; (36) GAM336487-A; (37) GAM337620-A; (38) GAM336809-A; (39) GAM5346-A; (40) GAM8554-A; (41) GAM2071-A; (42) GAM7957-A; (43) GAM391-A; (44) GAM6633-A; (45) GAM19; (46) GAM8358-A; (47) GAM3229-A; an) GAM 7052-A; (49) GAM3027-A; (50) GAM21 and (51) GAM oligonucleotide similar to mmu-MIR-30e.

The next validated GAM oligonucleotides are highly similar or highly identical to known mouse-miRNA oligonucleotides: GAM3027-A, similar to mmu-MIR-29c; GAM21, similar to mmu-MIR-130b; and GAM oligonucleotide which is highly similar to mmu-MIR-30e (picture number 51). In addition to the PCR—product hybridization detection, the following GAMs were cloned and sequenced: GAM3418-A, GAM5385-A, GAM1032-A, GAM3298-A, GAM7080-A, GAM1338-A, GAM7776-A, GAM25-A, GAM337624-A, GAM1479-A, GAM6773-A, GAM336818-A, GAM336487-A, GAM337620-A, GAM336809-A, GAM3027-A, GAM21, and GAM oligonucleotide similar to mmu-MIR-30e (picture number 51). Furthermore, the following GAM oligonucleotides were sequenced directly from the ligation reaction by the method described hereinbelow under LIGATION-PCR DIAGNOSTIC METHOD: GAM4426-A, GAM7553-A, GAM2270-A, and GAM7591-A.

In order to validate the expression of predicted novel GAM and assuming that these novel GAM oligonucleotides are probably expressed at low concentrations, a PCR product cloning approach was set up through the following strategy: two types of cDNA libraries designated "One tailed" and "Ligation" were prepared from frozen HeLa S100 extract (4c Biotech, Belgium) size fractionated RNA. Essentially, Total S100 RNA was prepared through an SDS-Proteinase K incubation followed by an acid Phenol-Chloroform purification and Isopropanol precipitation. Alternatively, total HeLa RNA was also used as starting material for these libraries.

Fractionation was done by loading up to 500 g per YM100 Amicon Microcon column (Millipore) followed by a 500 g centrifugation for 40 minutes at 4 C. Flow through "YM100"RNA consisting of about of the total RNA was used for library preparation or fractionated further by loading onto a YM30 Amicon Microcon column (Millipore) followed by a 13,500 g centrifugation for 25 minutes at 4 C. Flowthrough "YM30" was used for library preparation as is and consists of less than 0.5% of total RNA. For the both the "ligation" and the "One-tailed" libraries, RNA was dephosphorylated and ligated to an RNA (lowercase)-DNA (UPPERCASE) hybrid 5"-phosphorylated, 3"idT blocked 3"-adapter (5"-P-uuuAACCGCATCCTTCTC-idT-3" (SEQ ID NO: 7419) Dharmacon #P-002045-01-05) (as elaborated in Elbashir et al., Genes Dev. 15:188-200 (2001)) resulting in ligation only of RNase III type cleavage products. 3"-Ligated RNA was excised and purified from a half 6%, half 13% polyacrylamide gel to remove excess adapter with a Nanosep 0.2M centrifugal device (PalI) according to instructions, and precipitated with glycogen and 3 volumes of Ethanol. Pellet was resuspended in a minimal volume of water.

For the "ligation" library a DNA (UPPERCASE)-RNA (lowercase) hybrid 5"-adapter (5"-TACTAATACGACT-CACTaaa-3" (SEQ ID NO: 7420) Dharmacon # P-002046-01-05) was ligated to the 3"-adapted RNA, reverse transcribed with "EcoRI-RT": (5"-GACTAGCTGGAATTCAAGGATGCGGTTAAA-3") (SEQ ID NO: 7421), PCR amplified with two external primers essentially as in Elbashir et al 200 1 except that primers were "EcoRI-RT" and "PstI Fwd" (5"-CAGCCAACGCTG-CAGATACGACTCACTAAA-3") (SEQ ID NO: 7422). This PCR product was used as a template for a second round of PCR with one hemispecific and one external primer or with two hemispecific primers.

For the "One tailed" library the 3"-Adapted RNA was annealed to 20 pmol primer "EcoRI RT" by heating to 70 C and cooling 0.1 C/sec to 30 C and then reverse transcribed with Superscript II RT (According to instructions, Invitrogen) in a 20 l volume for 10 alternating 5 minute cycles of 37 C and 45 C. Subsequently, RNA was digested with 1 1 2M NaOH, 2 mM EDTA at 65 C for 10 minutes. cDNA was loaded on a polyacrylamide gel, excised and gel-purified from excess primer as above (invisible, judged by primer run alongside) and resuspended in 13 l of water. Purified cDNA was then oligo-dC tailed with 400 U of recombinant terminal transferase (Roche molecular biochemicals), 1 l 100M dCTP, 1 l 15 mM CoCl2, and 4 l reaction buffer, to a final volume of 20 l for 15 minutes at 37 C. Reaction was stopped with 2 l 0.2M EDTA and 15 l 3M NaOAc pH 5.2. Volume was adjusted to 150 l with water, Phenol:Bromochloropropane 10:1 extracted and subsequently precipitated with glycogen and 3 volumes of Ethanol. C-tailed cDNA was used as a template for PCR with the external primers "T3-PstBsg(G/I) 18" (5"-AAT-TAACCCTCACTAAAGGCTGCAGGTGCAG-GIGGGIIGGGIIGG GIIGN-3" (SEQ ID NO: 7423) where I stands for Inosine and N for any of the 4 possible deoxynucleotides), and with "EcoRI Nested" (5"-GGAATTCAAGGAT-GCGGTTA-3")" (SEQ ID NO: 7424). This PCR product was used as a template for a second round of PCR with one hemispecific and one external primer or with two hemispecific primers.

Hemispecific primers were constructed for each predicted GAM RNA oligonucleotide by an in-house program designed to choose about half of the 5" or 3" sequence of the GAM RNA corresponding to a TM of about 30-34 C constrained by an optimized 3"clamp, appended to the cloning adapter sequence (for "One-tailed" libraries 5"-GGN-NGGGNNG (SEQ ID NO: 7425) on the 5" end of the GAM RNA, or TTTAACCGCATC-3" (SEQ ID NO: 7426) on the 3"end of the GAM RNA. For "Ligation" libraries the same 3" adapter and 5"-CGACTCACTAAA (SEQ ID NO: 7427) on the 5" end). Consequently, a fully complementary primer of a TM higher than 60 C was created covering only one half of the GAM RNA sequence permitting the unbiased elucidation by sequencing of the other half.

Confirmation of GAM Oligonucleotide Sequence Authenticity of PCR Products:

SOUTHERN BLOT: PCR-product sequences were confirmed by southern blot (Southern E. M., Biotechnology, 1992, 24:122-39 (1975)) and hybridization with DNA oligonucleotide probes synthesized against predicted GAM RNAs oligonucleotides. Gels were transferred onto a Biodyne PLUS 0.45 m, (PalI) positively charged nylon membrane and UV cross-linked. Hybridization was performed overnight with DIG-labeled probes at 420 C in DIG EasyHyb buffer (Roche). Membranes were washed twice with 2×SSC and 0.1% SDS for 10 min. at 420 C and then washed twice with 0.5×SSC and 0.1% SDS for 5 min at 420 C. The membrane was then developed by using a DIG luminescent detection kit (Roche) using anti-DIG and CSPD reaction, according to the manufacturer's protocol. All probes were prepared according to the manufacturers (Roche Molecular Biochemicals) protocols: Digoxigenin (DIG) labeled antisense transcripts was prepared from purified PCR products using a DIG RNA labeling kit with T3 RNA polymerase. DIG labeled PCR was prepared by using a DIG PCR labeling kit. 3"-DIG-tailed oligo ssDNA antisense probes, containing DIG-dUTP and dATP at an average tail length of 50 nucleotides were prepared from 100 pmole oligonucleotides with the DIG Oligonucleotide Labeling Kit.

CLONE-SEQUENCING: PCR products were inserted into pGEM-T (Promega) or pTZ57 (MBI Fermentas), transformed into competent JM109 *E. coli* (Promega) and sown on LB-Amp plates with IPTG/Xgal. White and light-blue colonies were transferred to duplicate gridded plates, one of which was blotted onto a membrane (Biodyne Plus, PalI) for hybridization with DIG tailed oligo probes (according to instructions, Roche) corresponding to the expected GAM. Plasmid DNA from positive colonies was sequenced.

LIGATION-PCR DIAGNOSTIC METHOD: To further validate predicted GAM PCR product sequence derived from hemiprimers, a PCR based diagnostic technique was devised to amplify only those products containing also at least two additional nucleotides of the non hemi-primer defined part of the predicted GAM RNA oligonucleotide. In essence, a diagnostic primer was designed so that its 3" end, which is the specificity determining side, was identical to the desired GAMRNA oligonucleotide, 2-10 nucleotides (typically 4-7, chosen for maximum specificity) further into its 3" end than the nucleotide stretch primed by the hemi-primer. The hemi-primer PCR product was first ligated into a T-cloning vector (pTZ57/T or pGEM-T) as described herinabove. The ligation reaction mixture was used as template for the diagnostic PCR under strict annealing conditions with the new diagnostic primer in conjunction with a general plasmid-homologous primer, resulting in a distinct ~200 base-pair product. This PCR product can be directly sequenced, permitting the elucidation of the remaining nucleotides up to the 3" of the mature GAM RNA oligonucleotide adjacent to the 3" adapter. Alternatively, following analysis of the diagnostic PCR reaction on an agarose gel, positive ligation reactions (containing a band of the expected size) were transformed into *E. coli*. Using this same diagnostic technique and as an alternative to screening by Southern-blot colonyhybridization, transformed bacterial colonies were screened by colony-PCR (Gussow, D. and Clackson, T, Nucleic Acids Res. 17: 4000 (1989)) prior to plasmid purification and sequencing.

Reference is now made to FIG. 22B which is a table summarizing laboratory results which validate the expression of 8 known human miRNA oligonucleotides and 43 novel GAM oligonucleotides detected by the BIOINFORMATIC OLIGONUCLEOTIDE DETECTION ENGINE 100. The table gives additional information on the above GAM oligonucleotides and contains the following fields: NUMBER: refer to the hybridization picture number of FIG. 22A; NAME: indicate the known MIR name for the reference set or GAM's name as given by RosettaGenomices nomenclature method; SEQUENCE: 5' to 3' sequence of the mature, 'diced' oligonucleotide; SEQUENCED: '+' indicates a validation of the GAM RNA sequence by sequencing procedure as described hereinabove with reference to FIG. 22A.

Figures 23A, 23B, 23C:
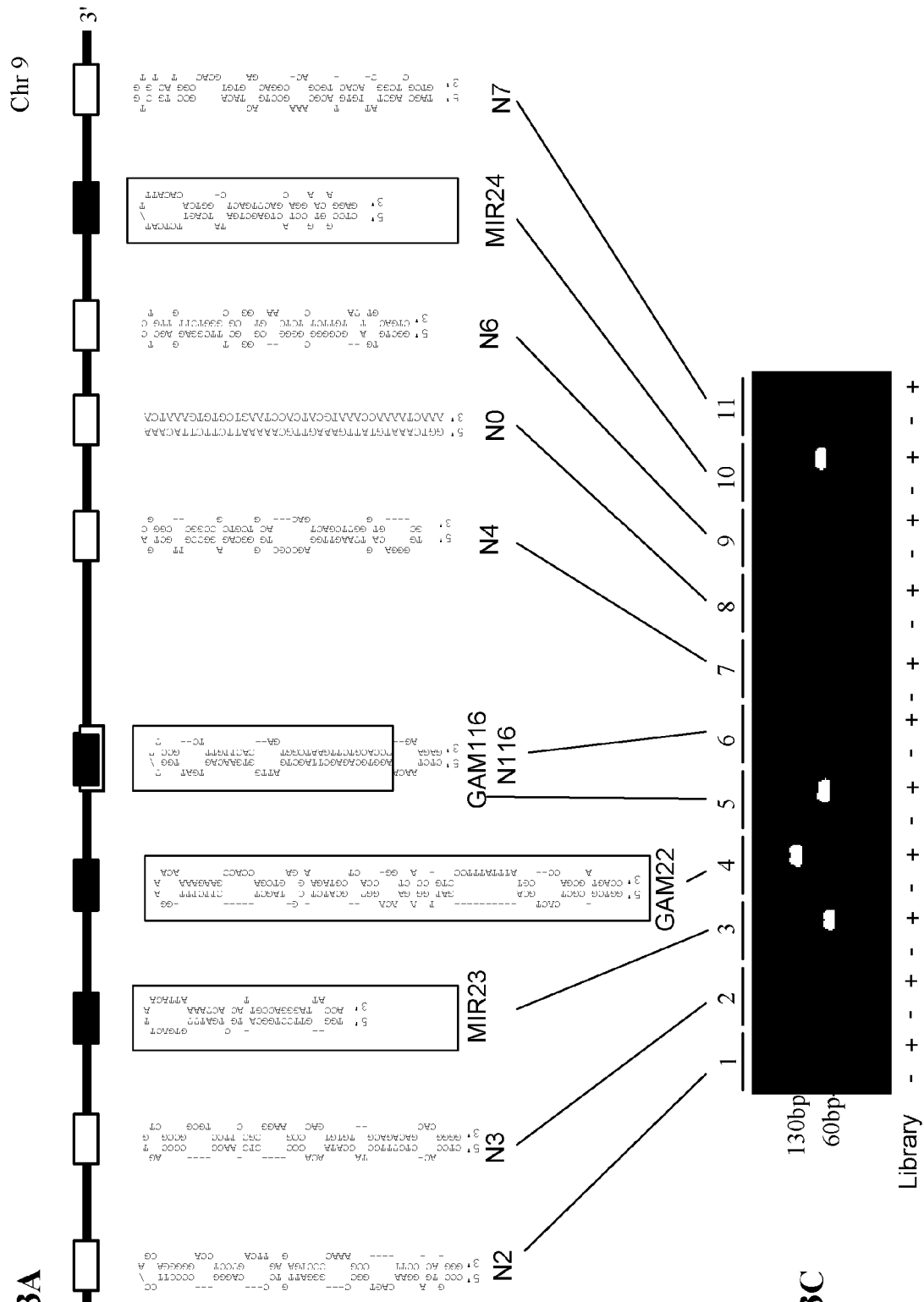
FIG. 23A is a schematic representation of an "operon-like" cluster of novel hairpin sequences detected bioinformatically by a bioinformatic oligonucleotide detection engine constructed and operative in accordance with a preferred embodiment of the present invention, and non-GAM hairpin useful as negative controls thereto.
FIG. 23B is a schematic representation of secondary folding of hairpins of the operon-like cluster of FIG. 23A. The hairpins shown are as follows: N2 (SEQ ID NO: 7403), N3 (SEQ ID NO: 7404), MIR23 (SEQ ID NO: 7405), GAM22 (SEQ ID NO: 7406), GAM116 (SEQ ID NO: 7407), N116 (SEQ ID NO: 7408), N4 (SEQ ID NO: 7409), N0 (SEQ ID NO: 7410), N6 (SEQ ID NO: 7411), MIR24 (SEQ ID NO: 7412), and N7 (SEQ ID NO: 7413)
FIG. 23C is a picture of laboratory results demonstrating expression of novel oligonucleotides of FIGS. 23A and 23B, and lack of expression of the negative controls, thereby validating efficacy of bioinformatic detection of GAM oligonucleotides and GR polynucleotides of the present invention, by a bioinformatic oligonucleotide detection engine constructed and operative in accordance with a preferred embodiment of the present invention.

Reference is now made to FIG. 23A, which is a schematic representation of a novel human GR polynucleotide herein designated GR12731 (RosettaGenomics Ltd. nomenclature), located on chromosome 9, comprising 2 known human MIR genes—MIR24 and MIR23, and 2 novel GAM oligonucleotides, herein designated GAM22 and GAM116, all marked by solid black boxes. FIG. 23A also schematically illustrates 6 non-GAM hairpin sequences, and one non-hairpin sequence, all marked by white boxes, and serving as negative controls. By "non-GAM hairpin sequences" is meant sequences of a similar length to known MIR PRECURSOR sequences, which form hairpin secondary folding pattern similar to MIR PRECURSOR hairpins, and yet which are assessed by the BIOINFORMATIC OLIGONUCLEOTIDE DETECTION ENGINE 100 not to be valid GAM PRECURSOR hairpins. It is appreciated that FIG. 23A is a simplified schematic representation, reflecting only the order in which the segments of interest appear relative to one another, and not a proportional distance between the segments.

Reference is now made to FIG. 23B, which is a schematic representation of secondary folding of each of the MIRs and GAMs of GR GR12731 MIR24, MIR23, GAM22 and GAM116, and of the negative control non-GAM hairpins, herein designated N2, N3, N116, N4, N6 and N7. N0 is a non-hairpin control, of a similar length to that of known MIR PRECURSOR hairpins. It is appreciated that the negative controls are situated adjacent to and in between real MIR genes and GAM predicted oligonucleotide and demonstrates similar secondary folding patterns to that of known MIRs and GAMs.

Reference is now made to FIG. 23C, which is a picture of laboratory results of a PCR test upon a YM100 "ligation"-library, utilizing specific primer sets directly inside the boundaries of the hairpins. Due to the nature of the library the only PCR amplifiable products can result from RNaseIII type enzyme cleaved RNA, as expected for legitimate hairpin precursors presumed to be produced by DROSHA (Lee et al, Nature 425 415-419, 2003). FIG. 23C demonstrates expression of hairpin precursors of known MIR genes—MIRhsa-23 and MIRhsa-24, and of novel bioinformatically detected GAM22 and GAM116 hairpins predicted bioinformatically by a system constructed and operative in accordance with a preferred embodiment of the present invention. FIG. 23C also shows that none of the 7 controls (6 hairpins designated N2, N3, N23, N4, N6 and N7 and 1 non-hairpin sequence designated N0) were expressed. N116 is a negative control sequence partially overlapping GAM116.

In the picture, test lanes including template are designated "+" and the control lane is designated "−". It is appreciated that for each of the tested hairpins, a clear PCR band appears in the test ("+") lane, but not in the control ("−") lane.

FIGS. 23A through 23C, when taken together validate the efficacy of the bioinformatic oligonucleotide detection engine in: (a) detecting known MIR genes; (b) detecting novel GAM PRECURSOR hairpins which are found adjacent to these MIR genes, and which despite exhaustive prior biological efforts and bioinformatic detection efforts, went undetected; (c) discerning between GAM (or MIR) PRECURSOR hairpins, and non-GAM hairpins.

It is appreciated that the ability to discern GAM-hairpins from non-GAM-hairpins is very significant in detecting GAM oligonucleotide since hairpins in general are highly abundant in the genome. Other MIR prediction programs have not been able to address this challenge successfully.

Reference is now made to FIG. 24A which is an annotated sequence of an EST comprising a novel GAM oligonucleotides detected by the oligonucleotide detection system of the present invention. FIG. 24A shows the nucleotide sequence of a known human non-protein coding EST (Expressed Sequence Tag), identified as EST72223. The EST72223 clone obtained from TIGR database (Kirkness and Kerlavage, 1997) was sequenced to yield the above 705 bp transcript with a polyadenyl tail. It is appreciated that the sequence of this EST comprises sequences of one known miRNA oligonucleotide, identified as hsa-MIR98, and of one novel GAM oligonucleotide referred to here as GAM25, detected by the BIOINFORMATIC OLIGONUCLEOTIDE DETECTION ENGINE 100 (FIG. 9) of the present invention.

The sequences of the precursors of the known MIR98 and of the predicted GAM25 are precursor in bold, the sequences of the established miRNA 98 and of the predicted miRNA-like oligonucleotide GAM25 are underlined.

Figure 24D:
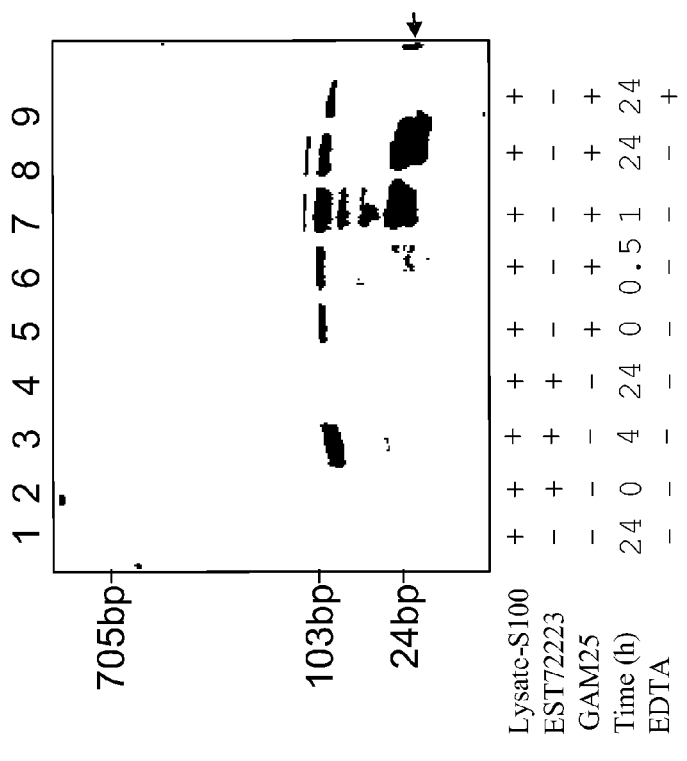
Figure 24C:
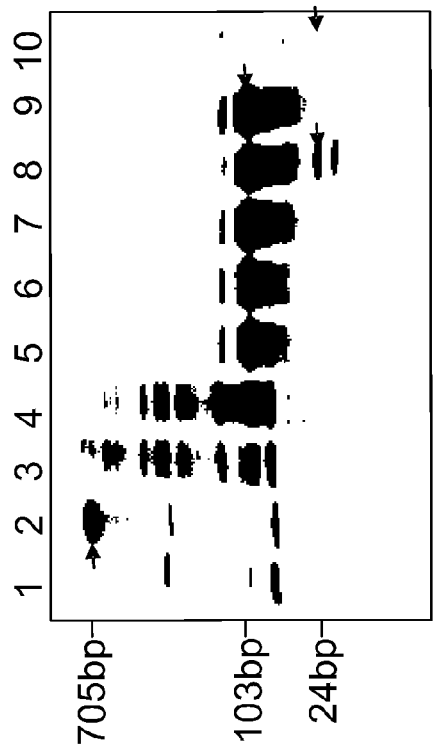

Reference is now made to FIGS. 24B, 24C and 24D that are pictures of laboratory results, which when taken together demonstrate laboratory confirmation of expression of the bioinformatically detected novel oligonucleotide of FIG. 24A. In two parallel experiments, an enzymatically synthesized capped, EST72223 RNA transcript, was incubated with Hela S100 lysate for 0 minutes, 4 hours and 24 hours. RNA was subsequently harvested, run on a denaturing polyacrylamide gel, and reacted with a 102 nt and a 145 nt antisense MIR98 and GAM25 precursor transcript probes respectively. The Northern blot results of these experiments demonstrated processing of EST72223 RNA by Hela lysate (lanes 2-4, in 24B and 24C), into ~80 bp and ~22 bp segments, which reacted with the MIR98 precursor probe (24B), and into ~100 bp and ~24 bp segments, which reacted with the GAM25 precursor probe (24C). These results demonstrate the processing of EST72223 by Hela lysate into MIR98 precursor and GAM25 precursor. It is also appreciated from FIG. 24C (lane 1) that Hela lysate itself reacted with the GAM25 precursor probe, in a number of bands, including a ~100 bp band, indicating that GAM25-precursor is endogenously expressed in Hela cells. The presence of additional bands, higher than 100 bp in lanes 5-9 probably corresponds to the presence of nucleotide sequences in Hela lysate, which contain the GAM25 sequence.

In addition, in order to demonstrate the kinetics and specificity of the processing of MIR98 and GAM25 precursors into their respective mature, 'diced' segments, transcripts of MIR98 and of the bioinformatically predicted GAM25 precursors were similarly incubated with Hela S100 lysate, for 0 minutes, 30 minutes, 1 hour and 24 hours, and for 24 hours with the addition of EDTA, added to inhibit Dicer activity, following which RNA was harvested, run on a polyacrylamide gel and reacted with MIR98 and GAM25 precursor probes. Capped transcripts were prepared for in-vitro RNA cleavage assays with T7 RNA polymerase including a m7G (5')ppp(5')G-capping reaction the Message Machine kit (Ambion). Purified PCR products were used as template for the reaction. These were amplified for each assay with specific primers containing a T7 promoter at the 5" end and a T3 RNA polymerase promoter at the 3" end. Capped RNA transcripts were incubated at 30 C in supplemented, dialysis concentrated, Hela S100 cytoplasmic extract (4 C Biotech, Seneffe, Belgium). The Hela S100 was supplemented by dialysis to a final concentration of 20 mM Hepes, 100 mM KCl, 2.5 mM MgCl2, 0.5 mM DTT, 20% glycerol and protease inhibitor cocktail tablets (Complete mini Roche Molecular Biochemicals). After addition of all components, final concentrations were 100 mM capped target RNA, 2 mM ATP, 0.2 mM GTP, 500 U/ml RNasin, 25 g/ml creatine kinase, 25 mM creatine phosphate, 2.5 mM DTT and 50% S100 extract. Proteinase K, used to enhance Dicer activity (Zhang et al., EMBO J. 21, 5875-5885 (2002)) was dissolved in 50 mM Tris-HCl pH 8, 5 mM CaCl2, and 50% glycerol, was added to a final concentration of 0.6 mg/ml. Cleavage reactions were stopped by the addition of 8 volumes of proteinase K buffer (200 Mm Tris-Hcl, pH 7.5, 25 mM EDTA, 300 mM NaCl, and 2% SDS) and incubated at 65 C for 15 min at different time points (0, 0.5, 1, 4, 24 h) and subjected to phenol/chloroform extraction. Pellets were dissolved in water and kept frozen. Samples were analyzed on a segmented half 6%, half 13% polyacrylamide 1XTBE-7M Urea gel.

The Northern blot results of these experiments demonstrated an accumulation of a ~22 bp segment which reacted with the MIR98 precursor probe, and of a ~24 bp segment which reacted with the GAM25 precursor probe, over time (lanes 5-8). Absence of these segments when incubated with EDTA (lane 9), which is known to inhibit Dicer enzyme (Zhang et al., 2002), supports the notion that the processing of MIR98 and GAM25 precursors into their 'diced' segments is mediated by Dicer enzyme, found in Hela lysate. The molecular sizes of EST72223, MIR-98 and GAM25 and their corresponding precursors are indicated by arrows.

FIG. 24D present Northern blot results of same above experiments with GAM25 probe (24 nt). The results clearly demonstrated the accumulation of mature GAM25 oligonucleotide after 24 h.

To validate the identity of the band shown by the lower arrow in FIGS. 24C and 24D, a RNA band parallel to a marker of 24 base was excised from the gel and cloned as in Elbashir et al (2001) and sequenced. 90 clones corresponded to the sequence of mature GAM25 oligonucleotide, three corresponded to GAM25* (the opposite arm of the hairpin with a 1-3 nucleotide 3" overhang) and two to the hairpin-loop.

GAM25 was also validated endogenously by sequencing from both sides from a HeLa YM100 total-RNA "ligation" libraries, utilizing hemispecific primers as described in FIG. 22.

Taken together, these results validate the presence and processing of a novel MIR-like oligonucleotide, GAM25, which was predicted bioinformatically. The processing of this novel GAM oligonucleotide product, by Hela lysate from EST72223, through its precursor, to its final form was similar to that observed for known miRNA oligonucleotide, MIR98.

Transcript products were 705 nt (EST72223), 102 nt (MIR98 precursor), 125 nt (GAM25 precursor) long. EST72223 was PCR amplified with T7-EST 72223 forward primer: 5"-TAATACGACTCACTATAGGCCCTTATTA-GAGGATTCTGCT-3" (SEQ ID NO: 7428) and T3-EST72223 reverse primer: "-AATTAACCCTCAC-TAAAGGTTTTTTTTTCCTGAGACAGAGT-3" (SEQ ID NO: 7429). MIR98 was PCR amplified using EST72223 as a template with T7MIR98 forward primer: 5-"TAATACGACT-CACTATAGGGTGAGGTAGTAAGTTGTATTGTT-3" (SEQ ID NO: 7430) and T3MIR98 reverse primer: 5"-AAT-TAACCCTCACTAAAGGGAAAGTAG-TAAGTTGTATAGTT-3" (SEQ ID NO: 7431). GAM25 was PCR amplified using EST72223 as a template with GAM25 forward primer: 5"-GAGGCAGGAGAATTGCTTGA-3" (SEQ ID NO: 7432) and T3-EST72223 reverse primer: 5"-AATTAACCCTCACTAAAGGCCTGAGACA-GAGTCTTGCTC-3" (SEQ ID NO: 7433).

It is appreciated that the data presented in FIGS. 24A, 24B, 24C and 24D when taken together validate the function of the bioinformatic oligonucleotide detection engine 100 of FIG. 9. FIG. 24A shows a novel GAM oligonucleotide bioinformatically detected by the BIOINFORMATIC OLIGONUCLE-OTIDE DETECTION ENGINE 100, and FIGS. 24C and 24D show laboratory confirmation of the expression of this novel oligonucleotide. This is in accord with the engine training and validation methodology described hereinabove with reference to FIG. 10.

DETAILED DESCRIPTION OF LARGE TABLES

Table 1 comprises data relating the SEQ ID NO of GAM RNA oligonucleotides of the present invention to their corresponding GAM NAME, and contains the following fields: GAM SEQ-ID: GAM SEQ ID NO, as in the Sequence Listing; GAM NAME: Rosetta Genomics Ltd. nomenclature (see below); GAM RNA SEQUENCE: Sequence (5' to 3') of the mature, 'diced' GAM RNA; GAM POS: Dicer cut location (see below); and Table 2 comprises detailed textual description according to the description of FIG. 8 of each of a plurality of novel GAM oligonucleotide of the present invention, and contains the following fields: GAM NAME: Rosetta Genomics Ltd. nomenclature (see below); PRECUR SEQ-ID: GAM precursor Seq-ID, as in the Sequence Listing; PRECURSOR SEQUENCE: Sequence (5' to 3') of the GAM precursor; GAM DESCRIPTION: Detailed description of GAM oligonucleotide with reference to FIG. 8; and Table 3 comprises data relating to the source and location of novel GAM oligonucleotides of the present invention, and contains the following fields: GAM NAME: Rosetta Genomics Ltd. nomenclature (see below); PRECUR SEQ-ID: GAM precursor SEQ ID NO, as in the Sequence Listing; ORGANISM: Abbreviated (hsa=Homo sapiens); CHR: Chromosome encoding the GAM oligonucleotide; STRAND: Orientation on the chromosome, '+' for the plus strand, '−' for the minus strand; CHR-START OFFSET Start offset of GAM precursor sequence on the chromosome; CHR-END OFFSET: End offset of GAM precursor sequence on the chromosome; SOURCE_REF-ID: Accession number of source sequence; and Table 4 comprises data relating to GAM precursors of novel GAM oligonucleotides of the present invention, and contains the following fields: GAM NAME: Rosetta Genomics Ltd. nomenclature (see below); PRECUR SEQ-ID: GAM precursor Seq-ID, as in the Sequence Listing; PRECURSOR-SEQUENCE: Sequence (5' to 3') of the GAM precursor; GAM FOLDED PRECURSOR RNA: Schematic representation of the GAM folded precursor, beginning 5' end (beginning of upper row) to 3' end (beginning of lower row), where the hairpin loop is positioned at the right part of the draw; and Table 5 comprises data relating to GAM oligonucleotides of the present invention, and contains the following fields: GAM NAME: Rosetta Genomics Ltd. nomenclature (see below); GAM RNA SEQUENCE: Sequence (5' to 3') of the mature, 'diced' GAM RNA; PRECUR SEQ-ID: GAM precursor Seq-ID, as in the Sequence Listing; SOURCE_REF_ID: accession number of the source sequence; GAM POS: Dicer cut location (see below); and Table 6 comprises data relating SEQ ID NO of the GAM target gene binding site sequence to TARGET gene name and target binding site sequence, and contains the following fields: TARGET BINDING SITE SEQ-ID: Target binding site SEQ ID NO, as in the Sequence Listing; TARGET: GAM target gene name; TARGET BINDING SITE SEQUENCE: Nucleotide sequence (5' to 3') of the target binding site; and Table 7 comprises data relating to target genes and binding sites of GAM oligonucleotides of the present invention, and contains the following fields: GAM NAME: Rosetta Genomics Ltd. nomenclature (see below); GAM RNA SEQUENCE: Sequence (5' to 3') of the mature, 'diced' GAM RNA; TARGET: GAM target gene name; TARGET REF-ID: Target accession number (GenBank); UTR: Untranslated region of binding site/s (3' or 5'); TARGET BS-SEQ: Nucleotide sequence (5' to 3') of the target binding site; BINDING-SITE-DRAW: Schematic representation of the binding site, upper row represent 5' to 3' sequence of the GAM RNA, lower row represent 3' to 5' sequence of the target binding site; GAM POS: Dicer cut location (see below); and Table 8 comprises data relating to functions and utilities of novel GAM oligonucleotides of the present invention, and contains the following fields: GAM NAME: Rosetta Genomics Ltd. nomenclature (see below); TARGET: GAM target gene name; GAM RNA SEQUENCE: Sequence (5' to 3') of the mature, 'diced' GAM RNA; GAM FUNCTION: Description of the GAM functions and utilities; GAM POS: Dicer cut location (see below); TAR DIS: Target Disease Relation Group (see below); and Table 9 comprises data of GAM target gene function references—Bibliography and contains the following fields: GAM NAME: Rosetta Genomics Ltd. nomenclature (see below); GAM RNA SEQUENCE: Sequence (5' to 3') of the mature, 'diced' GAM RNA; TARGET: GAM target gene name; REFERENCES: list of references related to the GAM target gene; GAM POS: Dicer cut location (see below); and Table 10 comprises data relating to novel GR (Genomic Record) polynucleotides of the present invention, and contains the following fields: GR NAME: Rosetta Genomics Ltd. nomenclature (see below); GR DESCRIPTION: Detailed description of a GR polynucleotide cluster, with reference to FIG. 16; and Table 11 comprises data relating to Alzheimers disease that GAM oligonucleotides are predicted to regulate the disease-associated genes. Each row is referred to a specific disease, and list the GAM target genes related to the disease. The first row is a summary of ALL target genes associated in Alzheimer disease containing in the present invention. The second row is a subset of the first row and contains all GAM target genes found to bind to at least one validated GAM oligonucleotide. The table contains the following fields: ROW#: index of the row number; DISEASE NAME: name of the disease; TARGET GENES ASSOCIATED WITH ALZHEIMER: list of GAM target genes that are associated with the specified disease; and The following conventions and abbreviations are used in the tables: The nucleotide 'U' is represented as 'T' in the tables, and GAM NAME or GR NAME are names for nucleotide sequences of the present invention given by RosettaGenomics Ltd. nomenclature method. All GAMs/GRs are designated by GAMx/GRx where x is a unique ID.

SOURCE REF-ID: The accession number of expressed sequences on which novel oligonucleotides were detected.

The sequences are taken from the following published databases: (1) TIGR—"Tentative Human Consensus" (THC) (2) EST database—UNIGENE, NCBI.

GAM POS is a position of the GAM RNA on the GAM PRECURSOR RNA sequence. This position is the Dicer cut location, 'A' indicates a probable Dicer cut location, 'B' indicates an alternative Dicer cut location.

TAR DIS (Target Disease Relation Group) 'A' indicates if the target gene is known to have a specific causative relation to Alzheimers disease, based on the OMIM database (Hamosh et al, 2002). It is appreciated that this is a partial classification emphasizing genes which are associated with "single gene" diseases etc. All GAM oligonucleotides of the present invention ARE associated with Alzheimers disease, although not all are necessary in 'A' status.

All genomic sequences of the present invention as well as their chromosomal location and strand orientation are derived from sequences records of NCBI, Build33 database (April, 2003).

It is appreciated by persons skilled in the art that the present invention is not limited by what has been particularly shown and described hereinabove. Rather the scope of the present invention includes both combinations and subcombinations of the various features described hereinabove as well as variations and modifications which would occur to persons skilled in the art upon reading the specifications and which are not in the prior art.

SEQUENCE LISTING (7433 sequences)

SEQ ID NO: 1 - RNA, 22 nt, Homo Sapiens
aaaaugcuuacaggcaguagcc

SEQ ID NO: 2 - RNA, 22 nt, Homo Sapiens
aaagugcucauagugcagguag

SEQ ID NO: 3 - RNA, 22 nt, Homo Sapiens
aaggcacuugcccagagcugca

SEQ ID NO: 4 - RNA, 23 nt, Homo Sapiens
aaucaucauuauuuugaaguuua

SEQ ID NO: 5 - RNA, 22 nt, Homo Sapiens
aauugcuugaacccaggaagug

SEQ ID NO: 6 - RNA, 22 nt, Homo Sapiens
acaugaucuccucacucuagga

SEQ ID NO: 7 - RNA, 22 nt, Homo Sapiens
acugcacuccagccugggcaac

SEQ ID NO: 8 - RNA, 22 nt, Homo Sapiens
agggcuguggguguggcugugc

SEQ ID NO: 9 - RNA, 22 nt, Homo Sapiens
aguagacaguggcaacauaguc

SEQ ID NO: 10 - RNA, 22 nt, Homo Sapiens
agugggauggagucagcagaag

SEQ ID NO: 11 - RNA, 22 nt, Homo Sapiens
aucacagaggcuuaagugcuga

SEQ ID NO: 12 - RNA, 22 nt, Homo Sapiens
aucacauugccagugauuaccc

SEQ ID NO: 13 - RNA, 22 nt, Homo Sapiens
cacugcacuccagccugggcaa

SEQ ID NO: 14 - RNA, 22 nt, Homo Sapiens
cauugcacuccagccugggcaa

SEQ ID NO: 15 - RNA, 22 nt, Homo Sapiens
cuagacugaagcuccuugagga

SEQ ID NO: 16 - RNA, 22 nt, Homo Sapiens
cuagccuguuuguccucacccc

SEQ ID NO: 17 - RNA, 22 nt, Homo Sapiens
gaaggcaguagguuguauaguu

SEQ ID NO: 18 - RNA, 22 nt, Homo Sapiens
gaaguuugaagccuguuguuca

SEQ ID NO: 19 - RNA, 22 nt, Homo Sapiens
guguuccaggaagucgucuuga

SEQ ID NO: 20 - RNA, 17 nt, Homo Sapiens
uaaggcauuuuuauggu

SEQ ID NO: 21 - RNA, 22 nt, Homo Sapiens
uaaggugcaucuagugcaguua

SEQ ID NO: 22 - RNA, 22 nt, Homo Sapiens
uaauacugccggguaaugaugg

SEQ ID NO: 23 - RNA, 22 nt, Homo Sapiens
uagcagcacauaaugguuugaa

SEQ ID NO: 24 - RNA, 22 nt, Homo Sapiens
uagguaguuuccuguuguuggg

SEQ ID NO: 25 - RNA, 22 nt, Homo Sapiens
ucaagcucauuccucuaaccuc

SEQ ID NO: 26 - RNA, 22 nt, Homo Sapiens
ucacagugaaccggucucuuuc

SEQ ID NO: 27 - RNA, 22 nt, Homo Sapiens
ucacugcaaccucugcugccug

SEQ ID NO: 28 - RNA, 22 nt, Homo Sapiens
ucggcagggaacaggaaguagg

SEQ ID NO: 29 - RNA, 22 nt, Homo Sapiens
ucuaagagaaaggaaguucaga

SEQ ID NO: 30 - RNA, 22 nt, Homo Sapiens
ucuugugaaaucuguggacccu

SEQ ID NO: 31 - RNA, 20 nt, Homo Sapiens
ugaggugggaucccgaggcc

SEQ ID NO: 32 - RNA, 17 nt, Homo Sapiens
uggcuagguaagggaag

SEQ ID NO: 33 - RNA, 22 nt, Homo Sapiens
uucagagugguuaagaucaugg

SEQ ID NO: 34 - RNA, 22 nt, Homo Sapiens
uuccucugccacgucuuucccu

SEQ ID NO: 35 - RNA, 22 nt, Homo Sapiens
uuggaguaauucaguauagguu

SEQ ID NO: 36 - RNA, 22 nt, Homo Sapiens
uuuccacagcggccaauucuuc

SEQ ID NO: 37 - RNA, 22 nt, Homo Sapiens
acgccgcugugggaaagcacuu

SEQ ID NO: 38 - RNA, 22 nt, Homo Sapiens
agaagguuggggcuggaggucu

SEQ ID NO: 39 - RNA, 22 nt, Homo Sapiens
ggccaggacucuugcagaacug

SEQ ID NO: 40 - RNA, 22 nt, Homo Sapiens
uggagcagaaaggcaggagucc

SEQ ID NO: 41 - RNA, 22 nt, Homo Sapiens
uggcaagugggcacuuuucagg

SEQ ID NO: 42 - RNA, 22 nt, Homo Sapiens
uggcacagaucagcagaacagg

SEQ ID NO: 43 - RNA, 22 nt, Homo Sapiens
uggaggcaggugcagauggagg

SEQ ID NO: 44 - RNA, 22 nt, Homo Sapiens
ugugcugguugcccccgagggg

SEQ ID NO: 45 - RNA, 22 nt, Homo Sapiens
ucccugagacucuuuaacuucu

SEQ ID NO: 46 - RNA, 22 nt, Homo Sapiens
ugaggcaggaguuggcaagagg

SEQ ID NO: 47 - RNA, 22 nt, Homo Sapiens
ugaggucauguucugucagguu

SEQ ID NO: 48 - RNA, 22 nt, Homo Sapiens
ggccugaggucagcaguagagg

SEQ ID NO: 49 - RNA, 22 nt, Homo Sapiens
ggcacugagaagcaaacaggau

SEQ ID NO: 50 - RNA, 22 nt, Homo Sapiens
gcccaggagucugaggcuggag

SEQ ID NO: 51 - RNA, 22 nt, Homo Sapiens
gccuggaugugaccacccucac

SEQ ID NO: 52 - RNA, 22 nt, Homo Sapiens
gcugcuccugcucucccucucc

SEQ ID NO: 53 - RNA, 22 nt, Homo Sapiens
gcuucuccuguccccucccuac

SEQ ID NO: 54 - RNA, 22 nt, Homo Sapiens
gguggguuuccuuaauggcauc

SEQ ID NO: 55 - RNA, 22 nt, Homo Sapiens
guccagugcucacugccgacau

SEQ ID NO: 56 - RNA, 22 nt, Homo Sapiens
guugggugugagggggguccca

SEQ ID NO: 57 - RNA, 22 nt, Homo Sapiens
aaauccuggggaucuggaggga

SEQ ID NO: 58 - RNA, 22 nt, Homo Sapiens
aggcagguggguguaugggucu

SEQ ID NO: 59 - RNA, 22 nt, Homo Sapiens
aggcaguguuguuccugauugc

SEQ ID NO: 60 - RNA, 22 nt, Homo Sapiens
aguggcccuggcccuggggcau

SEQ ID NO: 61 - RNA, 22 nt, Homo Sapiens
augaccugcagucagggcccag

SEQ ID NO: 62 - RNA, 22 nt, Homo Sapiens
ccagccugagguuccuggaggg

SEQ ID NO: 63 - RNA, 22 nt, Homo Sapiens
cugaggucaggaguucgagacc

SEQ ID NO: 64 - RNA, 22 nt, Homo Sapiens
cuggcucccucucuucucuccc

SEQ ID NO: 65 - RNA, 22 nt, Homo Sapiens
cuggcucccaggaggccucucu

SEQ ID NO: 66 - RNA, 22 nt, Homo Sapiens
cuuuggccacggggauaugaau

SEQ ID NO: 67 - RNA, 22 nt, Homo Sapiens
cuuuuugggguuuggggcuugg

SEQ ID NO: 68 - RNA, 22 nt, Homo Sapiens
uuccugguggaggcauucggag

SEQ ID NO: 69 - RNA, 22 nt, Homo Sapiens
uuguugcggguggggagaggau

SEQ ID NO: 70 - RNA, 22 nt, Homo Sapiens
uugucagaggcugguagggugu

SEQ ID NO: 71 - RNA, 22 nt, Homo Sapiens
uuugaaguggguccucgaaaug

SEQ ID NO: 72 - RNA, 22 nt, Homo Sapiens
uugcccaggcuggagugcagug

SEQ ID NO: 73 - RNA, 22 nt, Homo Sapiens
uugccuaggcuggagugcagug

SEQ ID NO: 74 - RNA, 22 nt, Homo Sapiens
uugccuaggccggagugcagug

SEQ ID NO: 75 - RNA, 22 nt, Homo Sapiens
uugcucaggcuggagugcagug

SEQ ID NO: 76 - RNA, 22 nt, Homo Sapiens
uucuggugaauucaggauggua

SEQ ID NO: 77 - RNA, 22 nt, Homo Sapiens
uugagcacaguuugaggagugu

SEQ ID NO: 78 - RNA, 22 nt, Homo Sapiens
uugcaaggaaggggaggaggcu

SEQ ID NO: 79 - RNA, 22 nt, Homo Sapiens
uugaugaaugggugcuccagga

SEQ ID NO: 80 - RNA, 22 nt, Homo Sapiens
uuuucugggcucccuuuucugc

SEQ ID NO: 81 - RNA, 22 nt, Homo Sapiens
gaacagcuccagucuacagccc

SEQ ID NO: 82 - RNA, 22 nt, Homo Sapiens
gacaugauguagcagaugaugg

SEQ ID NO: 83 - RNA, 22 nt, Homo Sapiens
gagcagguuuggaauggcucca

SEQ ID NO: 84 - RNA, 22 nt, Homo Sapiens
gaggucacuguuggaugucaga

SEQ ID NO: 85 - RNA, 22 nt, Homo Sapiens
gagguuugagccuucuccugcu

SEQ ID NO: 86 - RNA, 22 nt, Homo Sapiens
gagugagugugaucuuggcuca

SEQ ID NO: 87 - RNA, 22 nt, Homo Sapiens
cugugcccagccagggcugugu

SEQ ID NO: 88 - RNA, 22 nt, Homo Sapiens
cugcauggagguggucuaugag

SEQ ID NO: 89 - RNA, 22 nt, Homo Sapiens
cucacugcaaccuccgccuccc

SEQ ID NO: 90 - RNA, 22 nt, Homo Sapiens
cuccuaggcuggagugcagugg

SEQ ID NO: 91 - RNA, 22 nt, Homo Sapiens
cccaggcuggagugcaguggug

SEQ ID NO: 92 - RNA, 22 nt, Homo Sapiens
cccaggagguggagguuacagu

SEQ ID NO: 93 - RNA, 22 nt, Homo Sapiens
cgcuauguuggccaggcugguc

SEQ ID NO: 94 - RNA, 22 nt, Homo Sapiens
auugcuugagcccaggaguuca

SEQ ID NO: 95 - RNA, 22 nt, Homo Sapiens
cacccaggcuggagugcagugg

SEQ ID NO: 96 - RNA, 22 nt, Homo Sapiens
cagcaccaucagaugacuguau

SEQ ID NO: 97 - RNA, 22 nt, Homo Sapiens
agugguuucagggacuucugua

SEQ ID NO: 98 - RNA, 22 nt, Homo Sapiens
agguggcacugugugggguggg

SEQ ID NO: 99 - RNA, 22 nt, Homo Sapiens
agugauuuuccugccucagccu

SEQ ID NO: 100 - RNA, 22 nt, Homo Sapiens
aggcaguguuguuccugauugc

SEQ ID NO: 101 - RNA, 22 nt, Homo Sapiens
aggugagaaaacugaggcucag

SEQ ID NO: 102 - RNA, 22 nt, Homo Sapiens
aggcacugugcaggaugauggg

SEQ ID NO: 103 - RNA, 22 nt, Homo Sapiens
agacuggccucaagcucccaga

SEQ ID NO: 104 - RNA, 22 nt, Homo Sapiens
agaggcagagguuacaguagug

SEQ ID NO: 105 - RNA, 22 nt, Homo Sapiens
agcaccacaacagggacugggc

SEQ ID NO: 106 - RNA, 22 nt, Homo Sapiens
agcagagccaccaaauuuagug

SEQ ID NO: 107 - RNA, 22 nt, Homo Sapiens
aaauccagaaucuagacugaau

SEQ ID NO: 108 - RNA, 22 nt, Homo Sapiens
aagguggugucauguuuugggg

SEQ ID NO: 109 - RNA, 22 nt, Homo Sapiens
acugcagcuucagggacuugug

SEQ ID NO: 110 - RNA, 22 nt, Homo Sapiens
guuguguggaagaugcuuugcc

SEQ ID NO: 111 - RNA, 22 nt, Homo Sapiens
gugugggcagggccgugcuccc

SEQ ID NO: 112 - RNA, 22 nt, Homo Sapiens
gugaagaaguugcuucauccuu

SEQ ID NO: 113 - RNA, 22 nt, Homo Sapiens
gugcaucaggaucugaccagau

SEQ ID NO: 114 - RNA, 22 nt, Homo Sapiens
uaaugcucagcuggaccagugu

SEQ ID NO: 115 - RNA, 22 nt, Homo Sapiens
uagacugaggcuuccugcaggg

SEQ ID NO: 116 - RNA, 22 nt, Homo Sapiens
uagugcaauggcgcgaucucgg

SEQ ID NO: 117 - RNA, 22 nt, Homo Sapiens
ucaagcaauucucgugccucag

SEQ ID NO: 118 - RNA, 22 nt, Homo Sapiens
ucacagugauggguucaggaau

SEQ ID NO: 119 - RNA, 22 nt, Homo Sapiens
ucacccaggcuggagugcagug

SEQ ID NO: 120 - RNA, 22 nt, Homo Sapiens
ucacugcaaccuccaccucccg

SEQ ID NO: 121 - RNA, 22 nt, Homo Sapiens
ucacugcaaccucugccuuccg

SEQ ID NO: 122 - RNA, 22 nt, Homo Sapiens
ucacugcaaccucugcuucugg

SEQ ID NO: 123 - RNA, 22 nt, Homo Sapiens
ucacugcaaccuccgccugccg

SEQ ID NO: 124 - RNA, 22 nt, Homo Sapiens
ggaggaggaggcuggugcuggu

SEQ ID NO: 125 - RNA, 22 nt, Homo Sapiens
gcaggaugguuggacugaaggg

SEQ ID NO: 126 - RNA, 22 nt, Homo Sapiens
ggcagcugugcagagugggggu

SEQ ID NO: 127 - RNA, 22 nt, Homo Sapiens
ggcaggaucauagcucacugca

SEQ ID NO: 128 - RNA, 22 nt, Homo Sapiens
ggcagugucauuagcugauugu

SEQ ID NO: 129 - RNA, 22 nt, Homo Sapiens
ggcccaggagggggagaaaggc

SEQ ID NO: 130 - RNA, 22 nt, Homo Sapiens
ggcgugaucuuggcucaccaca

SEQ ID NO: 131 - RNA, 22 nt, Homo Sapiens
gguccacaaggggagagcaggg

SEQ ID NO: 132 - RNA, 22 nt, Homo Sapiens
ugacucaguggaagauccagag

SEQ ID NO: 133 - RNA, 22 nt, Homo Sapiens
ugacuugucugguuuggcaucu

SEQ ID NO: 134 - RNA, 22 nt, Homo Sapiens
ugaguauucaccaggugcuggg

SEQ ID NO: 135 - RNA, 22 nt, Homo Sapiens
ugauccucuggcuucagccucc

SEQ ID NO: 136 - RNA, 22 nt, Homo Sapiens
uccagugauucucgagggcaga

SEQ ID NO: 137 - RNA, 22 nt, Homo Sapiens
ucagagcagugccgaagcccag

SEQ ID NO: 138 - RNA, 22 nt, Homo Sapiens
ucagucguuucucucucccagc

SEQ ID NO: 139 - RNA, 22 nt, Homo Sapiens
ucugucauuuuucucuuuccau

SEQ ID NO: 140 - RNA, 22 nt, Homo Sapiens
uguguacuugucuuaguuugcu

SEQ ID NO: 141 - RNA, 22 nt, Homo Sapiens
uguccuuuguuuugagauggag

SEQ ID NO: 142 - RNA, 22 nt, Homo Sapiens
ugucucaguguagagacccaga

SEQ ID NO: 143 - RNA, 22 nt, Homo Sapiens
ugugaaggaggaagggaggagc

SEQ ID NO: 144 - RNA, 22 nt, Homo Sapiens
uuaccauguuggccaggcuggu

SEQ ID NO: 145 - RNA, 22 nt, Homo Sapiens
uucagcauugccaguguuucca

SEQ ID NO: 146 - RNA, 22 nt, Homo Sapiens
uggagccuuguuguuuguucac

SEQ ID NO: 147 - RNA, 22 nt, Homo Sapiens
uggaguaaaaugucagguguuu

SEQ ID NO: 148 - RNA, 22 nt, Homo Sapiens
ugggcucauuuugcagugauuu

SEQ ID NO: 149 - RNA, 22 nt, Homo Sapiens
ugugaaggaggaagggaggagc

SEQ ID NO: 150 - RNA, 22 nt, Homo Sapiens
uguguuggagcagaggcagggg

SEQ ID NO: 151 - RNA, 22 nt, Homo Sapiens
ucuuccccaccuucggcuugca

SEQ ID NO: 152 - RNA, 22 nt, Homo Sapiens
ucugagugggaacucucaugac

SEQ ID NO: 153 - RNA, 22 nt, Homo Sapiens
ucccugagcccugaaggguguu

SEQ ID NO: 154 - RNA, 22 nt, Homo Sapiens
ugacuggaggaagggagguaag

SEQ ID NO: 155 - RNA, 22 nt, Homo Sapiens
uagcaccuucugaaauaacgug

SEQ ID NO: 156 - RNA, 22 nt, Homo Sapiens
guguguggaaaugcagaugacc

SEQ ID NO: 157 - RNA, 22 nt, Homo Sapiens
aguuccauggaaaacaacaaag

SEQ ID NO: 158 - RNA, 22 nt, Homo Sapiens
cuggaagacaugguagagcuga

SEQ ID NO: 159 - RNA, 22 nt, Homo Sapiens
cugggcgugugaggcggcugug

SEQ ID NO: 160 - RNA, 22 nt, Homo Sapiens
uuuguaauagcaaaauacugga

SEQ ID NO: 161 - RNA, 22 nt, Homo Sapiens
uuguugcggguggggagaggau

SEQ ID NO: 162 - RNA, 22 nt, Homo Sapiens
uugcucaggcuggagugcagug

SEQ ID NO: 163 - RNA, 22 nt, Homo Sapiens
uuuguacgucaacucagccuua

SEQ ID NO: 164 - RNA, 22 nt, Homo Sapiens
uuugcaguguucaucaguauuu

SEQ ID NO: 165 - RNA, 22 nt, Homo Sapiens
cuugcacuccacagccugggug

SEQ ID NO: 166 - RNA, 22 nt, Homo Sapiens
gaggucuguuguucagaaaaau

SEQ ID NO: 167 - RNA, 22 nt, Homo Sapiens
cagaucugggauacagcugugg

SEQ ID NO: 168 - RNA, 22 nt, Homo Sapiens
augaccaggaauugagagacug

SEQ ID NO: 169 - RNA, 22 nt, Homo Sapiens
agcaaguguugaaacagcuggu

SEQ ID NO: 170 - RNA, 22 nt, Homo Sapiens
agauggaguuugagagggaaua

SEQ ID NO: 171 - RNA, 22 nt, Homo Sapiens
uauaugucugguauucuugggg

SEQ ID NO: 172 - RNA, 22 nt, Homo Sapiens
gccuggccuuccuguguuuuac

SEQ ID NO: 173 - RNA, 22 nt, Homo Sapiens
ucugagcccaggaguuugaggc

SEQ ID NO: 174 - RNA, 22 nt, Homo Sapiens
uucaggacuguggacugggcug

SEQ ID NO: 175 - RNA, 22 nt, Homo Sapiens
uggcagguaagccaccagcauc

SEQ ID NO: 176 - RNA, 22 nt, Homo Sapiens
ugcuaggcuuauucucuuccuc

SEQ ID NO: 177 - RNA, 22 nt, Homo Sapiens
ugagggcaggugugaaaaugcu

SEQ ID NO: 178 - RNA, 22 nt, Homo Sapiens
gcugcuccugcucucccucucc

SEQ ID NO: 179 - RNA, 22 nt, Homo Sapiens
ggcaaggaagaaagcagaaguu

SEQ ID NO: 180 - RNA, 22 nt, Homo Sapiens
guuuuaggcaacauaggaagac

SEQ ID NO: 181 - RNA, 22 nt, Homo Sapiens
agagcuaggaagauacaggguu

SEQ ID NO: 182 - RNA, 22 nt, Homo Sapiens
aggaaacauccucccccuuguu

SEQ ID NO: 183 - RNA, 22 nt, Homo Sapiens
aggcugcaguguaguggcauga

SEQ ID NO: 184 - RNA, 22 nt, Homo Sapiens
auggccuuuucucuuauccugg

SEQ ID NO: 185 - RNA, 22 nt, Homo Sapiens
agguggaguuuugcuuucccau

SEQ ID NO: 186 - RNA, 22 nt, Homo Sapiens
acuggaguuuguucaagaaaua

SEQ ID NO: 187 - RNA, 22 nt, Homo Sapiens
cacugcacuccagcccggcaac

SEQ ID NO: 188 - RNA, 22 nt, Homo Sapiens
cucacugcaaccuccgccuccc

SEQ ID NO: 189 - RNA, 22 nt, Homo Sapiens
cucccuccacuucugaggacgu

SEQ ID NO: 190 - RNA, 22 nt, Homo Sapiens
uugagcaaaauaucugguuuca

SEQ ID NO: 191 - RNA, 22 nt, Homo Sapiens
uucuggugaauucaggauggua

SEQ ID NO: 192 - RNA, 22 nt, Homo Sapiens
uugcucaggcuggagugcagug

SEQ ID NO: 193 - RNA, 22 nt, Homo Sapiens
uugccuaggcuggagugcagug

SEQ ID NO: 194 - RNA, 22 nt, Homo Sapiens
uugcccaggcuagagugcagug

SEQ ID NO: 195 - RNA, 22 nt, Homo Sapiens
uugcccaggcuggagugcagug

SEQ ID NO: 196 - RNA, 22 nt, Homo Sapiens
uuugcacacuuuccaaguugcc

SEQ ID NO: 197 - RNA, 22 nt, Homo Sapiens
cuccuaggcuggagugcagugg

SEQ ID NO: 198 - RNA, 22 nt, Homo Sapiens
cugggauuacaggugugaacca

SEQ ID NO: 199 - RNA, 22 nt, Homo Sapiens
gaagagcugugugcugugaugu

SEQ ID NO: 200 - RNA, 22 nt, Homo Sapiens
cacugcaagcuccaccucccgg

SEQ ID NO: 201 - RNA, 22 nt, Homo Sapiens
cacugcaaccuccaccuccugg

SEQ ID NO: 202 - RNA, 22 nt, Homo Sapiens
cacccaggcuggagugcagugg

SEQ ID NO: 203 - RNA, 22 nt, Homo Sapiens
caaagugcugagauuacaggca

SEQ ID NO: 204 - RNA, 22 nt, Homo Sapiens
cacugggauuacagaugugagc

SEQ ID NO: 205 - RNA, 22 nt, Homo Sapiens
cgcuauguuggccaggcugguc

SEQ ID NO: 206 - RNA, 22 nt, Homo Sapiens
ccuggagugacagguguagccu

SEQ ID NO: 207 - RNA, 22 nt, Homo Sapiens
cuaauuguuccugcagguagua

SEQ ID NO: 208 - RNA, 22 nt, Homo Sapiens
cccaggcuggagugcaguggug

SEQ ID NO: 209 - RNA, 22 nt, Homo Sapiens
ccaaagugcuaggauuacagcc

SEQ ID NO: 210 - RNA, 22 nt, Homo Sapiens
ccaaagugcugggauuacaggc

SEQ ID NO: 211 - RNA, 22 nt, Homo Sapiens
ccaaagugcuggcguuacaggu

SEQ ID NO: 212 - RNA, 22 nt, Homo Sapiens
acaguguuacccaggcuggucu

SEQ ID NO: 213 - RNA, 22 nt, Homo Sapiens
aagugcugggauuacaggccug

SEQ ID NO: 214 - RNA, 22 nt, Homo Sapiens
aagugcugguauuacaagugug

SEQ ID NO: 215 - RNA, 22 nt, Homo Sapiens
auggccuuuucucuuauccugg

SEQ ID NO: 216 - RNA, 22 nt, Homo Sapiens
augaccaggaauugagagacug

SEQ ID NO: 217 - RNA, 22 nt, Homo Sapiens
aggcugcaguguaguggcauga

SEQ ID NO: 218 - RNA, 22 nt, Homo Sapiens
agaugauguuggagucugugcu

SEQ ID NO: 219 - RNA, 22 nt, Homo Sapiens
gugcauuuguaguuaaaugugu

SEQ ID NO: 220 - RNA, 22 nt, Homo Sapiens
ucacagagacuugggccucaaa

SEQ ID NO: 221 - RNA, 22 nt, Homo Sapiens
ucacccaggcuggagugcagug

SEQ ID NO: 222 - RNA, 22 nt, Homo Sapiens
uaggaaguauuuuuuaaaaaca

SEQ ID NO: 223 - RNA, 22 nt, Homo Sapiens
uacaguaucuguaaaaacuguc

SEQ ID NO: 224 - RNA, 22 nt, Homo Sapiens
ggcuggagaguaaaucaggucu

SEQ ID NO: 225 - RNA, 22 nt, Homo Sapiens
gcccaggagucugaggcuggag

SEQ ID NO: 226 - RNA, 22 nt, Homo Sapiens
gcaagugcugucauauggaaga

SEQ ID NO: 227 - RNA, 22 nt, Homo Sapiens
ugagauggugucauauugcugg

SEQ ID NO: 228 - RNA, 22 nt, Homo Sapiens
ugaguauucaccaggugcuggg

SEQ ID NO: 229 - RNA, 22 nt, Homo Sapiens
ugcaagucugugauuuuguguu

SEQ ID NO: 230 - RNA, 22 nt, Homo Sapiens
uggagugucuggaggugucucu

SEQ ID NO: 231 - RNA, 22 nt, Homo Sapiens
ugggaagaugcuggcaaggugc

SEQ ID NO: 232 - RNA, 22 nt, Homo Sapiens
uuaccauguuggccaggcuggu

SEQ ID NO: 233 - RNA, 22 nt, Homo Sapiens
uuagauauguccccuucuauaa

SEQ ID NO: 234 - RNA, 22 nt, Homo Sapiens
uguccuuuguuuugagauggag

SEQ ID NO: 235 - RNA, 22 nt, Homo Sapiens
ugugucuguggaacagaagcag

SEQ ID NO: 236 - RNA, 22 nt, Homo Sapiens
uguggcuaguuugaacugagau

SEQ ID NO: 237 - RNA, 22 nt, Homo Sapiens
ugugagagaaauggcaaguugg

SEQ ID NO: 238 - RNA, 22 nt, Homo Sapiens
uucacauguugcucaguuuugc

SEQ ID NO: 239 - RNA, 22 nt, Homo Sapiens
uggcaggauuccugggauuuca

SEQ ID NO: 240 - RNA, 22 nt, Homo Sapiens
uggguuagugguugaauaguuu

SEQ ID NO: 241 - RNA, 22 nt, Homo Sapiens
uggagccuuguuguuuguucac

SEQ ID NO: 242 - RNA, 22 nt, Homo Sapiens
uggagagagcagguugcuaaga

SEQ ID NO: 243 - RNA, 22 nt, Homo Sapiens
uggagagaaagcgaagauguag

SEQ ID NO: 244 - RNA, 22 nt, Homo Sapiens
ugaaagagauguggugugugaa

SEQ ID NO: 245 - RNA, 22 nt, Homo Sapiens
ucugucauuuuucucuuuccau

SEQ ID NO: 246 - RNA, 22 nt, Homo Sapiens
uccaguacaggucucucauuuc

SEQ ID NO: 247 - RNA, 22 nt, Homo Sapiens
gcuguguuaacuguucaaacuc

SEQ ID NO: 248 - RNA, 22 nt, Homo Sapiens
gguccacaaggggagagcaggg

SEQ ID NO: 249 - RNA, 22 nt, Homo Sapiens
ggcccaggagggggagaaaggc

SEQ ID NO: 250 - RNA, 22 nt, Homo Sapiens
ggcaugugugagcagcugcagg

SEQ ID NO: 251 - RNA, 22 nt, Homo Sapiens
ggcaugauggagaggguggaga

SEQ ID NO: 252 - RNA, 22 nt, Homo Sapiens
uacaggcaggcacagaggcagu

SEQ ID NO: 253 - RNA, 22 nt, Homo Sapiens
uacucauuuaugcauuguuuug

SEQ ID NO: 254 - RNA, 22 nt, Homo Sapiens
uaggagugaaaauaaacucugu

SEQ ID NO: 255 - RNA, 22 nt, Homo Sapiens
uaggcagucucaguuguugggu

SEQ ID NO: 256 - RNA, 22 nt, Homo Sapiens
guccugagaacugcuccaguua

SEQ ID NO: 257 - RNA, 22 nt, Homo Sapiens
guguuauuaauaaacucuuuuu

SEQ ID NO: 258 - RNA, 22 nt, Homo Sapiens
agggcacacgucucucugaauu

SEQ ID NO: 259 - RNA, 22 nt, Homo Sapiens
auggauauuuuugaugcccaga

SEQ ID NO: 260 - RNA, 22 nt, Homo Sapiens
augaugagucuuagugaucugg

SEQ ID NO: 261 - RNA, 22 nt, Homo Sapiens
aucacuuugcagggauuacuaa

SEQ ID NO: 262 - RNA, 22 nt, Homo Sapiens
auucaagauaagggucugggag

SEQ ID NO: 263 - RNA, 22 nt, Homo Sapiens
aaguuuuuuuaaauuagcuagg

SEQ ID NO: 264 - RNA, 22 nt, Homo Sapiens
aaugugugggagaacagucuuu

SEQ ID NO: 265 - RNA, 22 nt, Homo Sapiens
cagcaguguugcgaaucaucac

SEQ ID NO: 266 - RNA, 22 nt, Homo Sapiens
gacaugauguagcagaugaugg

SEQ ID NO: 267 - RNA, 22 nt, Homo Sapiens
cuggugaggaaggagcagaguu

SEQ ID NO: 268 - RNA, 22 nt, Homo Sapiens
cugaaaugcuguugauuuuagu

SEQ ID NO: 269 - RNA, 22 nt, Homo Sapiens
uuugcaguguucaucaguauuu

SEQ ID NO: 270 - RNA, 22 nt, Homo Sapiens
uuuguaauagcaaaauacugga

SEQ ID NO: 271 - RNA, 22 nt, Homo Sapiens
ccaguacugucuugaugccugc

SEQ ID NO: 272 - RNA, 22 nt, Homo Sapiens
ccugcccauccugccuccacca

SEQ ID NO: 273 - RNA, 22 nt, Homo Sapiens
ucacugcaaccuccgccugccg

SEQ ID NO: 274 - RNA, 22 nt, Homo Sapiens
ugggaagaugcuggcaaggugc

SEQ ID NO: 275 - RNA, 22 nt, Homo Sapiens
uggcaaggugugggcuagagau

SEQ ID NO: 276 - RNA, 22 nt, Homo Sapiens
ugaguuuaagcuaagaagucug

SEQ ID NO: 277 - RNA, 22 nt, Homo Sapiens
guuguguggaagaugcuuugcc

SEQ ID NO: 278 - RNA, 22 nt, Homo Sapiens
guggcauuggugguggcauugg

SEQ ID NO: 279 - RNA, 22 nt, Homo Sapiens
gguggguuuccuuaauggcauc

SEQ ID NO: 280 - RNA, 22 nt, Homo Sapiens
guacuccagccugccuggguaa

SEQ ID NO: 281 - RNA, 22 nt, Homo Sapiens
ggcaugauucagcagaggagag

SEQ ID NO: 282 - RNA, 22 nt, Homo Sapiens
gggaggauccuugcucaacuua

SEQ ID NO: 283 - RNA, 22 nt, Homo Sapiens
ggccucagaagcugaggggaga

SEQ ID NO: 284 - RNA, 22 nt, Homo Sapiens
gcugcuccugcucucccucucc

SEQ ID NO: 285 - RNA, 22 nt, Homo Sapiens
ccugcccauccugccuccacca

SEQ ID NO: 286 - RNA, 22 nt, Homo Sapiens
ccagccugagguuccuggaggg

SEQ ID NO: 287 - RNA, 22 nt, Homo Sapiens
gagugagugugaucuuggcuca

SEQ ID NO: 288 - RNA, 22 nt, Homo Sapiens
gaggcagcaacuggugaggcac

SEQ ID NO: 289 - RNA, 22 nt, Homo Sapiens
aaacacaaugcaguaggaagag

SEQ ID NO: 290 - RNA, 22 nt, Homo Sapiens
acugcacuccauccuggggagc

SEQ ID NO: 291 - RNA, 22 nt, Homo Sapiens
agaaggcucgcucucucagggg

SEQ ID NO: 292 - RNA, 22 nt, Homo Sapiens
auggccuuuucucuuauccugg

SEQ ID NO: 293 - RNA, 22 nt, Homo Sapiens
auagaagagcagugggguagaa

SEQ ID NO: 294 - RNA, 22 nt, Homo Sapiens
agagauaaagagguuuaggcag

SEQ ID NO: 295 - RNA, 22 nt, Homo Sapiens
aggcagguggguguaugggucu

SEQ ID NO: 296 - RNA, 22 nt, Homo Sapiens
acugcacuccagccuggguggc

SEQ ID NO: 297 - RNA, 22 nt, Homo Sapiens
aaccugucauuccaaggacagu

SEQ ID NO: 298 - RNA, 22 nt, Homo Sapiens
gagauggaguuuuacuauguug

SEQ ID NO: 299 - RNA, 21 nt, Homo Sapiens
gacacaggcccagagaggcag

SEQ ID NO: 300 - RNA, 21 nt, Homo Sapiens
cuuuggcaagggagaagucac

SEQ ID NO: 301 - RNA, 22 nt, Homo Sapiens
cagaaucuuuugucucugagaa

SEQ ID NO: 302 - RNA, 22 nt, Homo Sapiens
auuugaggaggcuuuacagcca

SEQ ID NO: 303 - RNA, 22 nt, Homo Sapiens
ggaggcagugguugcagugagc

SEQ ID NO: 304 - RNA, 22 nt, Homo Sapiens
gugucucuguuguggcagucau

SEQ ID NO: 305 - RNA, 22 nt, Homo Sapiens
uaguuguuugggauugguagug

SEQ ID NO: 306 - RNA, 22 nt, Homo Sapiens
uacaggcaggcacagaggcagu

SEQ ID NO: 307 - RNA, 22 nt, Homo Sapiens
ucugugacuguauuuucccaaa

SEQ ID NO: 308 - RNA, 22 nt, Homo Sapiens
uucaggacuguggacugggcug

SEQ ID NO: 309 - RNA, 22 nt, Homo Sapiens
uuagcaguugugagacccuaga

SEQ ID NO: 310 - RNA, 22 nt, Homo Sapiens
uguguuggagcagaggcagggg

SEQ ID NO: 311 - RNA, 22 nt, Homo Sapiens
uggagcagaaaggcaggagucc

SEQ ID NO: 312 - RNA, 22 nt, Homo Sapiens
ucugccucccugucucacucuc

SEQ ID NO: 313 - RNA, 22 nt, Homo Sapiens
gcugcuccugcucucccucucc

SEQ ID NO: 314 - RNA, 22 nt, Homo Sapiens
gcuucuccuguccccucccuac

SEQ ID NO: 315 - RNA, 22 nt, Homo Sapiens
ggccugaggucagcaguagagg

SEQ ID NO: 316 - RNA, 22 nt, Homo Sapiens
ggcccaggagggggagaaaggc

SEQ ID NO: 317 - RNA, 22 nt, Homo Sapiens
cccuuuaguaacuugcaggguc

SEQ ID NO: 318 - RNA, 22 nt, Homo Sapiens
cuccuaggcuggagugcagugg

SEQ ID NO: 319 - RNA, 22 nt, Homo Sapiens
aauggcagucccuggagcagga

SEQ ID NO: 320 - RNA, 22 nt, Homo Sapiens
aucacuuugcagggauuacuaa

SEQ ID NO: 321 - RNA, 22 nt, Homo Sapiens
augaugcuggaacuggacaaca

SEQ ID NO: 322 - RNA, 22 nt, Homo Sapiens
augguguaggugaagagaacau

SEQ ID NO: 323 - RNA, 22 nt, Homo Sapiens
agguggcacugugugggguggg

SEQ ID NO: 324 - RNA, 22 nt, Homo Sapiens
agucagggagacugucaguaaa

SEQ ID NO: 325 - RNA, 22 nt, Homo Sapiens
agauaguucucuguuguugggg

SEQ ID NO: 326 - RNA, 22 nt, Homo Sapiens
agcuggauuguuuaccuggggc

SEQ ID NO: 327 - RNA, 22 nt, Homo Sapiens
acagcaguccagccugggugac

SEQ ID NO: 328 - RNA, 22 nt, Homo Sapiens
aaucuucacuaaaauggacaag

SEQ ID NO: 329 - RNA, 22 nt, Homo Sapiens
aagguggugucauguuuugggg

SEQ ID NO: 330 - RNA, 22 nt, Homo Sapiens
aaggcuguguaggcagaauucu

SEQ ID NO: 331 - RNA, 22 nt, Homo Sapiens
cuggcucuacccucucacuuca

SEQ ID NO: 332 - RNA, 22 nt, Homo Sapiens
gaccagccauccugguuuacau

SEQ ID NO: 333 - RNA, 22 nt, Homo Sapiens
gaauaaugucccacugggaggc

SEQ ID NO: 334 - RNA, 22 nt, Homo Sapiens
gagcuaaggauagaggugagga

SEQ ID NO: 335 - RNA, 22 nt, Homo Sapiens
gaggugaaggaacaaaugcuga

SEQ ID NO: 336 - RNA, 22 nt, Homo Sapiens
cuagcacagugcuuggcacaca

SEQ ID NO: 337 - RNA, 22 nt, Homo Sapiens
cguguucaguauggugggagau

SEQ ID NO: 338 - RNA, 22 nt, Homo Sapiens
caagugcuugaacauggcagag

SEQ ID NO: 339 - RNA, 22 nt, Homo Sapiens
auuuuucugcauuuguauugga

SEQ ID NO: 340 - RNA, 22 nt, Homo Sapiens
cagaucugggauacagcugugg

SEQ ID NO: 341 - RNA, 22 nt, Homo Sapiens
cagagcauuugugaggaguguu

SEQ ID NO: 342 - RNA, 22 nt, Homo Sapiens
cagugcugaguaugaaaggccc

SEQ ID NO: 343 - RNA, 22 nt, Homo Sapiens
cauaaaaucagaaaguauuacu

SEQ ID NO: 344 - RNA, 22 nt, Homo Sapiens
ggcccaggagggggagaaaggc

SEQ ID NO: 345 - RNA, 22 nt, Homo Sapiens
ggaggugacuguuacagaucgg

SEQ ID NO: 346 - RNA, 22 nt, Homo Sapiens
ggccugguggcuguuguuuugg

SEQ ID NO: 347 - RNA, 22 nt, Homo Sapiens
ggcugcagugaacuaugaucgu

SEQ ID NO: 348 - RNA, 22 nt, Homo Sapiens
ggcugggcaugguggcucacgc

SEQ ID NO: 349 - RNA, 22 nt, Homo Sapiens
gcuggguugagcugggcugaga

SEQ ID NO: 350 - RNA, 22 nt, Homo Sapiens
gauugcuugagcccuggagguu

SEQ ID NO: 351 - RNA, 22 nt, Homo Sapiens
gcagcgcugagaugauuuguug

SEQ ID NO: 352 - RNA, 22 nt, Homo Sapiens
uaugauuguuucauuuguugga

SEQ ID NO: 353 - RNA, 22 nt, Homo Sapiens
uauuaguugauuccaagggacc

SEQ ID NO: 354 - RNA, 22 nt, Homo Sapiens
guuacagcucucaaagaagaca

SEQ ID NO: 355 - RNA, 22 nt, Homo Sapiens
guuauugucagggucucccuuu

SEQ ID NO: 356 - RNA, 22 nt, Homo Sapiens
uaagaagagaaagaagaggcug

SEQ ID NO: 357 - RNA, 22 nt, Homo Sapiens
ucucuaagacaaaggagaaguc

SEQ ID NO: 358 - RNA, 22 nt, Homo Sapiens
ucuuggugcuuuugcuggauga

SEQ ID NO: 359 - RNA, 22 nt, Homo Sapiens
ucuugggauagugucucauggc

SEQ ID NO: 360 - RNA, 22 nt, Homo Sapiens
uccucaucuuugagucccagcg

SEQ ID NO: 361 - RNA, 22 nt, Homo Sapiens
ucaggcugaggucaucugcauc

SEQ ID NO: 362 - RNA, 22 nt, Homo Sapiens
ugaugacugaaguggccuggac

SEQ ID NO: 363 - RNA, 22 nt, Homo Sapiens
ugcagccuugaacucuuucugg

SEQ ID NO: 364 - RNA, 22 nt, Homo Sapiens
ugagauggugucauauugcugg

SEQ ID NO: 365 - RNA, 22 nt, Homo Sapiens
ugagggcaggugugaaaaugcu

SEQ ID NO: 366 - RNA, 22 nt, Homo Sapiens
uggcucugucuauugggaugug

SEQ ID NO: 367 - RNA, 22 nt, Homo Sapiens
uggggcacuguggaggugucau

SEQ ID NO: 368 - RNA, 22 nt, Homo Sapiens
uucaggacuguggacugggcug

SEQ ID NO: 369 - RNA, 22 nt, Homo Sapiens
uugugguuuucccaggugguag

SEQ ID NO: 370 - RNA, 22 nt, Homo Sapiens
uucuaugauucucuaaguagca

SEQ ID NO: 371 - RNA, 22 nt, Homo Sapiens
uucuggguuuuuguggguuugc

SEQ ID NO: 372 - RNA, 22 nt, Homo Sapiens
uguagcagaacacuggguccag

SEQ ID NO: 373 - RNA, 22 nt, Homo Sapiens
gccaggaugaagaggaggagaa

SEQ ID NO: 374 - RNA, 22 nt, Homo Sapiens
ggccugguggcuguuguuuugg

SEQ ID NO: 375 - RNA, 22 nt, Homo Sapiens
ggcaaggaagaaagcagaaguu

SEQ ID NO: 376 - RNA, 22 nt, Homo Sapiens
gacaugauguagcagaugaugg

SEQ ID NO: 377 - RNA, 22 nt, Homo Sapiens
aggcacugugcaggaugauggg

SEQ ID NO: 378 - RNA, 22 nt, Homo Sapiens
agcuccaggagcuggcaggagg

SEQ ID NO: 379 - RNA, 22 nt, Homo Sapiens
acugcacuccagccuggguggc

SEQ ID NO: 380 - RNA, 22 nt, Homo Sapiens
gagcuaaggauagaggugagga

SEQ ID NO: 381 - RNA, 22 nt, Homo Sapiens
cugcugccuuucucucagagau

SEQ ID NO: 382 - RNA, 22 nt, Homo Sapiens
ccacugcacuccagccugggug

SEQ ID NO: 383 - RNA, 22 nt, Homo Sapiens
ggcaugauggagaggguggaga

SEQ ID NO: 384 - RNA, 22 nt, Homo Sapiens
uuaaacuucccugcugccccag

SEQ ID NO: 385 - RNA, 22 nt, Homo Sapiens
ugaggaggugcuaccagcgucu

SEQ ID NO: 386 - RNA, 22 nt, Homo Sapiens
ugagagagcaagugaauuuccc

SEQ ID NO: 387 - RNA, 22 nt, Homo Sapiens
uccauugcacuccagucugggc

SEQ ID NO: 388 - RNA, 22 nt, Homo Sapiens
ugagaucaucguuacaagcagc

SEQ ID NO: 389 - RNA, 22 nt, Homo Sapiens
ugagaugaaccagguaucucag

SEQ ID NO: 390 - RNA, 22 nt, Homo Sapiens
uucacauguugcucaguuuugc

SEQ ID NO: 391 - RNA, 22 nt, Homo Sapiens
ugguccagaggaggaaugaggg

SEQ ID NO: 392 - RNA, 22 nt, Homo Sapiens
uggaauggcugaagacugugaa

SEQ ID NO: 393 - RNA, 22 nt, Homo Sapiens
ugcuguaguauguauauaguau

SEQ ID NO: 394 - RNA, 22 nt, Homo Sapiens
ggcaugauggagaggguggaga

SEQ ID NO: 395 - RNA, 22 nt, Homo Sapiens
ggcccaggagggggagaaaggc

SEQ ID NO: 396 - RNA, 22 nt, Homo Sapiens
ggcaugugugagcagcugcagg

SEQ ID NO: 397 - RNA, 22 nt, Homo Sapiens
ggccugaggucagcaguagagg

SEQ ID NO: 398 - RNA, 22 nt, Homo Sapiens
gcagcucccuauuccaugacag

SEQ ID NO: 399 - RNA, 22 nt, Homo Sapiens
ggaggcagugguugcagugagc

SEQ ID NO: 400 - RNA, 22 nt, Homo Sapiens
gucuuguuccaguuucucagcc

SEQ ID NO: 401 - RNA, 22 nt, Homo Sapiens
gaggagguggggcagcagcagg

SEQ ID NO: 402 - RNA, 22 nt, Homo Sapiens
gagguagagguugcagugaguc

SEQ ID NO: 403 - RNA, 22 nt, Homo Sapiens
gaggucacuguuggaugucaga

SEQ ID NO: 404 - RNA, 22 nt, Homo Sapiens
gagguagagguugcagugagug

SEQ ID NO: 405 - RNA, 22 nt, Homo Sapiens
agaaguaguaguagcaguagua

SEQ ID NO: 406 - RNA, 22 nt, Homo Sapiens
aaccugcugguaaagcacuggc

SEQ ID NO: 407 - RNA, 22 nt, Homo Sapiens
agacuguuccgucagacucagu

SEQ ID NO: 408 - RNA, 22 nt, Homo Sapiens
aggcaagagguugcagugagcu

SEQ ID NO: 409 - RNA, 22 nt, Homo Sapiens
auacagcucucucuggggacuu

SEQ ID NO: 410 - RNA, 22 nt, Homo Sapiens
uugagagcauagagccaggaag

SEQ ID NO: 411 - RNA, 22 nt, Homo Sapiens
gaggucacuguuggaugucaga

SEQ ID NO: 412 - RNA, 22 nt, Homo Sapiens
ccagccugagguuccuggaggg

SEQ ID NO: 413 - RNA, 22 nt, Homo Sapiens
uuccaguucucagcacagcgcu

SEQ ID NO: 414 - RNA, 22 nt, Homo Sapiens
ucccuucagagcccauggguuu

SEQ ID NO: 415 - RNA, 22 nt, Homo Sapiens
ucuuggugcuuuugcuggauga

SEQ ID NO: 416 - RNA, 22 nt, Homo Sapiens
ucuuccccaccuucggcuugca

SEQ ID NO: 417 - RNA, 22 nt, Homo Sapiens
ucugccucccugucucacucuc

SEQ ID NO: 418 - RNA, 22 nt, Homo Sapiens
ugauauauaaucagcccaugau

SEQ ID NO: 419 - RNA, 22 nt, Homo Sapiens
ugugcacaacaugcagguuugu

SEQ ID NO: 420 - RNA, 22 nt, Homo Sapiens
uaggcccauuaauaguguacau

SEQ ID NO: 421 - RNA, 22 nt, Homo Sapiens
ggagcuguaguuuuucccacau

SEQ ID NO: 422 - RNA, 22 nt, Homo Sapiens
cagcagagcccauguguucaug

SEQ ID NO: 423 - RNA, 22 nt, Homo Sapiens
cagguacuuuuugguuuacaug

SEQ ID NO: 424 - RNA, 22 nt, Homo Sapiens
cugggcaguaauguaguugaga

SEQ ID NO: 425 - RNA, 22 nt, Homo Sapiens
aggcaagagguugcagugagcu

SEQ ID NO: 426 - RNA, 22 nt, Homo Sapiens
agaugacacagagcucaggaaa

SEQ ID NO: 427 - RNA, 22 nt, Homo Sapiens
uugcuuugguucaaguuaggca

SEQ ID NO: 428 - RNA, 22 nt, Homo Sapiens
uugguugcugaugagcuuugag

SEQ ID NO: 429 - RNA, 22 nt, Homo Sapiens
uuuauuaguuguccuugguuua

SEQ ID NO: 430 - RNA, 22 nt, Homo Sapiens
uuguaaauaacauuuuuuagca

SEQ ID NO: 431 - RNA, 22 nt, Homo Sapiens
uugagcaaaauaucugguuuca

SEQ ID NO: 432 - RNA, 22 nt, Homo Sapiens
uugcacuccagccuggguaaca

SEQ ID NO: 433 - RNA, 22 nt, Homo Sapiens
uugcacuccagccugggugaca

SEQ ID NO: 434 - RNA, 22 nt, Homo Sapiens
uuuggggucuccccagcaugca

SEQ ID NO: 435 - RNA, 22 nt, Homo Sapiens
uuuuuguggaauauuuuuuuaa

SEQ ID NO: 436 - RNA, 22 nt, Homo Sapiens
agcagcacagaaauauuggcac

SEQ ID NO: 437 - RNA, 22 nt, Homo Sapiens
aggcaagagguugcagugagcu

SEQ ID NO: 438 - RNA, 22 nt, Homo Sapiens
agguccucacacacagcucugc

SEQ ID NO: 439 - RNA, 22 nt, Homo Sapiens
aggguuguuaguuuuuugguug

SEQ ID NO: 440 - RNA, 22 nt, Homo Sapiens
aguagaacagaauauuuuagcu

SEQ ID NO: 441 - RNA, 22 nt, Homo Sapiens
augggagacugaggggcggacg

SEQ ID NO: 442 - RNA, 22 nt, Homo Sapiens
auugcacuccagccugggcaau

SEQ ID NO: 443 - RNA, 22 nt, Homo Sapiens
auugcacuccagccugggugac

SEQ ID NO: 444 - RNA, 22 nt, Homo Sapiens
auugcacuccagcuugggcaac

SEQ ID NO: 445 - RNA, 22 nt, Homo Sapiens
auugcacuucagccugggugac

SEQ ID NO: 446 - RNA, 22 nt, Homo Sapiens
auggagcuguuuucuucagagc

SEQ ID NO: 447 - RNA, 22 nt, Homo Sapiens
augccuguaaucccagcacuuu

SEQ ID NO: 448 - RNA, 22 nt, Homo Sapiens
augccuguaaucccagcauuuu

SEQ ID NO: 449 - RNA, 22 nt, Homo Sapiens
aaauugccgagaugauguuugg

SEQ ID NO: 450 - RNA, 22 nt, Homo Sapiens
aagcagaacuguuuuguuuucu

SEQ ID NO: 451 - RNA, 22 nt, Homo Sapiens
aacccuggaggcagagguugcg

SEQ ID NO: 452 - RNA, 22 nt, Homo Sapiens
aagguggugucauguuuugggg

SEQ ID NO: 453 - RNA, 22 nt, Homo Sapiens
aaugaagccacagagauuugcu

SEQ ID NO: 454 - RNA, 22 nt, Homo Sapiens
aaucccagcuacucgggaggcu

SEQ ID NO: 455 - RNA, 22 nt, Homo Sapiens
acacaucuaauggcugugcuga

SEQ ID NO: 456 - RNA, 22 nt, Homo Sapiens
acaaaaaauuagccagacuggu

SEQ ID NO: 457 - RNA, 22 nt, Homo Sapiens
acuguacuucagccuggguaac

SEQ ID NO: 458 - RNA, 22 nt, Homo Sapiens
acuguacuccagccugggcaac

SEQ ID NO: 459 - RNA, 22 nt, Homo Sapiens
acuguacuucagccugggcaac

SEQ ID NO: 460 - RNA, 22 nt, Homo Sapiens
acugcacucuagccugggcaac

SEQ ID NO: 461 - RNA, 22 nt, Homo Sapiens
acugcacuucagccugggcaau

SEQ ID NO: 462 - RNA, 22 nt, Homo Sapiens
acugcacuccagccuggcgaca

SEQ ID NO: 463 - RNA, 22 nt, Homo Sapiens
acugcacuccagccugggcgau

SEQ ID NO: 464 - RNA, 22 nt, Homo Sapiens
acccgagagguggagguugcag

SEQ ID NO: 465 - RNA, 22 nt, Homo Sapiens
acugcacuccagccuggcaaca

SEQ ID NO: 466 - RNA, 22 nt, Homo Sapiens
cuugcacuccacagccugggug

SEQ ID NO: 467 - RNA, 22 nt, Homo Sapiens
cugaggcaggagggcucaggag

SEQ ID NO: 468 - RNA, 22 nt, Homo Sapiens
cuccuaggcuggagugcagugg

SEQ ID NO: 469 - RNA, 22 nt, Homo Sapiens
cucuugaaggaguauuuguguu

SEQ ID NO: 470 - RNA, 22 nt, Homo Sapiens
cucugccucccgggucuaggcu

SEQ ID NO: 471 - RNA, 22 nt, Homo Sapiens
gagguagagguugcagugagug

SEQ ID NO: 472 - RNA, 22 nt, Homo Sapiens
gagguagagguugcagugaguc

SEQ ID NO: 473 - RNA, 22 nt, Homo Sapiens
gacuggcuaauuuauaaaggaa

SEQ ID NO: 474 - RNA, 22 nt, Homo Sapiens
cacugcacuccagccugggcga

SEQ ID NO: 475 - RNA, 22 nt, Homo Sapiens
cacugcacuccagccuggguaa

SEQ ID NO: 476 - RNA, 22 nt, Homo Sapiens
cacugcacuccagccuggguga

SEQ ID NO: 477 - RNA, 22 nt, Homo Sapiens
auuguucuccagccugggcgac

SEQ ID NO: 478 - RNA, 22 nt, Homo Sapiens
auugcacaccaaccugggcaac

SEQ ID NO: 479 - RNA, 22 nt, Homo Sapiens
cacugcacucagccugggugac

SEQ ID NO: 480 - RNA, 22 nt, Homo Sapiens
cacugcacuccacccugggcaa

SEQ ID NO: 481 - RNA, 22 nt, Homo Sapiens
ccagccugagguuccuggaggg

SEQ ID NO: 482 - RNA, 22 nt, Homo Sapiens
cccaggaggcggagguugcagu

SEQ ID NO: 483 - RNA, 22 nt, Homo Sapiens
ccacugcacuccagccugggug

SEQ ID NO: 484 - RNA, 22 nt, Homo Sapiens
ccaaagugcuggcguuacaggu

SEQ ID NO: 485 - RNA, 22 nt, Homo Sapiens
cauugcacuccagccuggguga

SEQ ID NO: 486 - RNA, 22 nt, Homo Sapiens
ccaaagugcuaggaauacaggu

SEQ ID NO: 487 - RNA, 22 nt, Homo Sapiens
cguguaaucccagcuacuuggg

SEQ ID NO: 488 - RNA, 22 nt, Homo Sapiens
ggaggcagugguugcagugagc

SEQ ID NO: 489 - RNA, 22 nt, Homo Sapiens
gcuguguuaacuguucaaacuc

SEQ ID NO: 490 - RNA, 22 nt, Homo Sapiens
gaguauuaccuauaucaccgug

SEQ ID NO: 491 - RNA, 22 nt, Homo Sapiens
gcacucaagccuggguuacaga

SEQ ID NO: 492 - RNA, 22 nt, Homo Sapiens
gcaagugcugucauauggaaga

SEQ ID NO: 493 - RNA, 22 nt, Homo Sapiens
gccuguaaucccagcuacuugg

SEQ ID NO: 494 - RNA, 22 nt, Homo Sapiens
gccauugcacuccagccugggc

SEQ ID NO: 495 - RNA, 22 nt, Homo Sapiens
gccauugcacuccagccuggac

SEQ ID NO: 496 - RNA, 22 nt, Homo Sapiens
ggcuggagaguaaaucaggucu

SEQ ID NO: 497 - RNA, 22 nt, Homo Sapiens
gggcaugaugauggcacuagcg

SEQ ID NO: 498 - RNA, 19 nt, Homo Sapiens
gggggaugauagcagccag

SEQ ID NO: 499 - RNA, 22 nt, Homo Sapiens
ggcaugugugagcagcugcagg

SEQ ID NO: 500 - RNA, 22 nt, Homo Sapiens
ggaggaggugugaagaaaugaa

SEQ ID NO: 501 - RNA, 22 nt, Homo Sapiens
ggaguguaaagaaggauguuac

SEQ ID NO: 502 - RNA, 22 nt, Homo Sapiens
uaggaaguauuuuuuaaaaaca

SEQ ID NO: 503 - RNA, 22 nt, Homo Sapiens
uacccugugaucaucugugugc

SEQ ID NO: 504 - RNA, 22 nt, Homo Sapiens
uaaugcucagcuggaccagugu

SEQ ID NO: 505 - RNA, 22 nt, Homo Sapiens
uauugaucugucccagccugug

SEQ ID NO: 506 - RNA, 22 nt, Homo Sapiens
uauugcacuccagccugggcaa

SEQ ID NO: 507 - RNA, 22 nt, Homo Sapiens
uauugcuaagaauucagguagu

SEQ ID NO: 508 - RNA, 22 nt, Homo Sapiens
uauaacagccagcuuggauuca

SEQ ID NO: 509 - RNA, 22 nt, Homo Sapiens
uauuacauucauuuugaugguu

SEQ ID NO: 510 - RNA, 22 nt, Homo Sapiens
gugcuugaccaugugguggcag

SEQ ID NO: 511 - RNA, 22 nt, Homo Sapiens
guggccuuucuggucuguguau

SEQ ID NO: 512 - RNA, 22 nt, Homo Sapiens
guacuccagccugccuggguaa

SEQ ID NO: 513 - RNA, 22 nt, Homo Sapiens
guauguauuuauagauguucuu

SEQ ID NO: 514 - RNA, 22 nt, Homo Sapiens
gguggguuuccuuaauggcauc

SEQ ID NO: 515 - RNA, 22 nt, Homo Sapiens
gucuuccuccguccccaccucc

SEQ ID NO: 516 - RNA, 22 nt, Homo Sapiens
gugaagaaguugcuucauccuu

SEQ ID NO: 517 - RNA, 22 nt, Homo Sapiens
uguagcagaacacuggguccag

SEQ ID NO: 518 - RNA, 22 nt, Homo Sapiens
uguaaacauccccgacuggaag

SEQ ID NO: 519 - RNA, 22 nt, Homo Sapiens
uucauuaggccaggugcggugg

SEQ ID NO: 520 - RNA, 22 nt, Homo Sapiens
uuccaguaguuacuccucccug

SEQ ID NO: 521 - RNA, 22 nt, Homo Sapiens
uucagcauugccaguguuucca

SEQ ID NO: 522 - RNA, 22 nt, Homo Sapiens
uuaacugagaggaucugaguag

SEQ ID NO: 523 - RNA, 22 nt, Homo Sapiens
ugcuacauuucuucauucuugg

SEQ ID NO: 524 - RNA, 22 nt, Homo Sapiens
uggaagaauaggcaguauugga

SEQ ID NO: 525 - RNA, 22 nt, Homo Sapiens
uggcaggauuccugggauuuca

SEQ ID NO: 526 - RNA, 22 nt, Homo Sapiens
ugagaugaacccgguaccucag

SEQ ID NO: 527 - RNA, 22 nt, Homo Sapiens
ugcagauacauguguaacugaa

SEQ ID NO: 528 - RNA, 22 nt, Homo Sapiens
ugaggaaggugugagaaaugag

SEQ ID NO: 529 - RNA, 22 nt, Homo Sapiens
ugaggcagaaggauuacuugag

SEQ ID NO: 530 - RNA, 22 nt, Homo Sapiens
ugagggggaaggugugugugug

SEQ ID NO: 531 - RNA, 22 nt, Homo Sapiens
ucauaaacuggcaagcacuacc

SEQ ID NO: 532 - RNA, 22 nt, Homo Sapiens
ucauugguugcauaauuugauc

SEQ ID NO: 533 - RNA, 22 nt, Homo Sapiens
ugaaguaguuagguuguagcuc

SEQ ID NO: 534 - RNA, 22 nt, Homo Sapiens
ugcagauacauguguaacugaa

SEQ ID NO: 535 - RNA, 22 nt, Homo Sapiens
uggggcacuguggaggugucau

SEQ ID NO: 536 - RNA, 22 nt, Homo Sapiens
uggagagauagugauuuagcuc

SEQ ID NO: 537 - RNA, 22 nt, Homo Sapiens
guucuggagcccauacucacca

SEQ ID NO: 538 - RNA, 22 nt, Homo Sapiens
guucuucugggagaaaaauggc

SEQ ID NO: 539 - RNA, 22 nt, Homo Sapiens
ucaaagcugcagauugccugug

SEQ ID NO: 540 - RNA, 22 nt, Homo Sapiens
ggcagcugugcagagugggggu

SEQ ID NO: 541 - RNA, 22 nt, Homo Sapiens
gggggaucauuauaaaaauacu

SEQ ID NO: 542 - RNA, 22 nt, Homo Sapiens
gccaggaugaagaggaggagaa

SEQ ID NO: 543 - RNA, 22 nt, Homo Sapiens
gaaaguaguaaguuguauaguu

SEQ ID NO: 544 - RNA, 22 nt, Homo Sapiens
gaacuguacuggacccauaguu

SEQ ID NO: 545 - RNA, 22 nt, Homo Sapiens
gaggacccuuaggucagacaga

SEQ ID NO: 546 - RNA, 22 nt, Homo Sapiens
cucaccaguuacucuccaguug

SEQ ID NO: 547 - RNA, 22 nt, Homo Sapiens
cugaauguaaucuuaguuguaa

SEQ ID NO: 548 - RNA, 22 nt, Homo Sapiens
cuggagaggagcggucacuggu

SEQ ID NO: 549 - RNA, 22 nt, Homo Sapiens
acugcacuccagucugggugac

SEQ ID NO: 550 - RNA, 22 nt, Homo Sapiens
uuugcaccugagacagauagcc

SEQ ID NO: 551 - RNA, 22 nt, Homo Sapiens
uugccuggagacauuucuacug

SEQ ID NO: 552 - RNA, 22 nt, Homo Sapiens
acugcagcuucagggacuugug

SEQ ID NO: 553 - RNA, 22 nt, Homo Sapiens
acacaggcccagagaggcagug

SEQ ID NO: 554 - RNA, 22 nt, Homo Sapiens
aggggguuuagcuccacagggu

SEQ ID NO: 555 - RNA, 22 nt, Homo Sapiens
agagacacagacacaugggaga

SEQ ID NO: 556 - RNA, 22 nt, Homo Sapiens
cugugccugugacgagggauga

SEQ ID NO: 557 - RNA, 22 nt, Homo Sapiens
gaccccuugcccguggcuccca

SEQ ID NO: 558 - RNA, 22 nt, Homo Sapiens
ccccaccccaguggagcucacc

SEQ ID NO: 559 - RNA, 22 nt, Homo Sapiens
cccaggaggcggagguugcagu

SEQ ID NO: 560 - RNA, 22 nt, Homo Sapiens
cacugcaacccccgccucccag

SEQ ID NO: 561 - RNA, 22 nt, Homo Sapiens
gcuucuccuguccccucccuac

SEQ ID NO: 562 - RNA, 22 nt, Homo Sapiens
ggcugggcaugguggcucacgc

SEQ ID NO: 563 - RNA, 22 nt, Homo Sapiens
guucuggagcccauacucacca

SEQ ID NO: 564 - RNA, 22 nt, Homo Sapiens
guguauguguguaugucugugu

SEQ ID NO: 565 - RNA, 22 nt, Homo Sapiens
guacaguggguguagggaccag

SEQ ID NO: 566 - RNA, 22 nt, Homo Sapiens
uguggcagaaggcucuggauua

SEQ ID NO: 567 - RNA, 22 nt, Homo Sapiens
ugaggacaggagguugugaguu

SEQ ID NO: 568 - RNA, 22 nt, Homo Sapiens
ucagagcagugccgaagcccag

SEQ ID NO: 569 - RNA, 22 nt, Homo Sapiens
ucuuccccaccuucggcuugca

SEQ ID NO: 570 - RNA, 22 nt, Homo Sapiens
guggaguucucugcuaguccua

SEQ ID NO: 571 - RNA, 22 nt, Homo Sapiens
uaaaguguguaugggcaggugu

SEQ ID NO: 572 - RNA, 22 nt, Homo Sapiens
ggaguguaaagaaggauguuac

SEQ ID NO: 573 - RNA, 22 nt, Homo Sapiens
gacauggagacaacagccaaau

SEQ ID NO: 574 - RNA, 22 nt, Homo Sapiens
gagcagguuuggaauggcucca

SEQ ID NO: 575 - RNA, 22 nt, Homo Sapiens
gaggucacuguuggaugucaga

SEQ ID NO: 576 - RNA, 22 nt, Homo Sapiens
cucagauacuugggagguugag

SEQ ID NO: 577 - RNA, 22 nt, Homo Sapiens
aaggcuguguaggcagaauucu

SEQ ID NO: 578 - RNA, 22 nt, Homo Sapiens
agaaguguaaauaaguauguau

SEQ ID NO: 579 - RNA, 22 nt, Homo Sapiens
uuugcacacuuuccaaguugcc

SEQ ID NO: 580 - RNA, 22 nt, Homo Sapiens
uuuguaauagcaaaauacugga

SEQ ID NO: 581 - RNA, 22 nt, Homo Sapiens
uuuucaauggcugacacugucu

SEQ ID NO: 582 - RNA, 22 nt, Homo Sapiens
uuuuuaucuuuuucuccagaug

SEQ ID NO: 583 - RNA, 22 nt, Homo Sapiens
uugguugcugaugagcuuugag

SEQ ID NO: 584 - RNA, 22 nt, Homo Sapiens
uuuccuguuuugguuuggagag

SEQ ID NO: 585 - RNA, 22 nt, Homo Sapiens
uugcacuccagucugggugaca

SEQ ID NO: 586 - RNA, 22 nt, Homo Sapiens
uucucauuggcccacaggggua

SEQ ID NO: 587 - RNA, 22 nt, Homo Sapiens
agaagguuggggcuggaggucu

SEQ ID NO: 588 - RNA, 22 nt, Homo Sapiens
acuggcccacuccauuuagggu

SEQ ID NO: 589 - RNA, 22 nt, Homo Sapiens
acugcacuccagucugggugac

SEQ ID NO: 590 - RNA, 20 nt, Homo Sapiens
acaggagcauggagaggcua

SEQ ID NO: 591 - RNA, 22 nt, Homo Sapiens
aagcagccuuggaccaggaggg

SEQ ID NO: 592 - RNA, 22 nt, Homo Sapiens
aacacguugcaucugugucucu

SEQ ID NO: 593 - RNA, 22 nt, Homo Sapiens
aaccugcugguaaagcacuggc

SEQ ID NO: 594 - RNA, 22 nt, Homo Sapiens
aggugagaaaacugaggcucag

SEQ ID NO: 595 - RNA, 22 nt, Homo Sapiens
augguguaggugaagagaacau

SEQ ID NO: 596 - RNA, 22 nt, Homo Sapiens
augggcaguuucuucccuuucc

SEQ ID NO: 597 - RNA, 22 nt, Homo Sapiens
aguauuucuuguuuuauugaga

SEQ ID NO: 598 - RNA, 22 nt, Homo Sapiens
agguggaguuuugcuuucccau

SEQ ID NO: 599 - RNA, 22 nt, Homo Sapiens
cucugccucccgggucuaggcu

SEQ ID NO: 600 - RNA, 22 nt, Homo Sapiens
cugugcauguugauauccuggc

SEQ ID NO: 601 - RNA, 22 nt, Homo Sapiens
cuggcucccucucuucucuccc

SEQ ID NO: 602 - RNA, 22 nt, Homo Sapiens
gagguagagguugcagugagug

SEQ ID NO: 603 - RNA, 22 nt, Homo Sapiens
gagguagagguugcagugaguc

SEQ ID NO: 604 - RNA, 22 nt, Homo Sapiens
gagagugcuuuggguguaggcc

SEQ ID NO: 605 - RNA, 22 nt, Homo Sapiens
gaaaccuacacaucccacuaac

SEQ ID NO: 606 - RNA, 22 nt, Homo Sapiens
cagaggaugcggcugggaacgg

SEQ ID NO: 607 - RNA, 22 nt, Homo Sapiens
caugguacugccacagaagagu

SEQ ID NO: 608 - RNA, 22 nt, Homo Sapiens
ccaggguacucugggaucacuu

SEQ ID NO: 609 - RNA, 22 nt, Homo Sapiens
cuacuuguuccucucaccucaa

SEQ ID NO: 610 - RNA, 22 nt, Homo Sapiens
ggaguaugagagagaaugggac

SEQ ID NO: 611 - RNA, 22 nt, Homo Sapiens
ggcaugauggagaggguggaga

SEQ ID NO: 612 - RNA, 22 nt, Homo Sapiens
gggggaucauuauaaaaauacu

SEQ ID NO: 613 - RNA, 22 nt, Homo Sapiens
gguagcuagaggggagauagca

SEQ ID NO: 614 - RNA, 22 nt, Homo Sapiens
ggugaugcauuuaaaagggcag

SEQ ID NO: 615 - RNA, 22 nt, Homo Sapiens
gcugcuccugcucucccucucc

SEQ ID NO: 616 - RNA, 22 nt, Homo Sapiens
ggaggcagugguugcagugagc

SEQ ID NO: 617 - RNA, 22 nt, Homo Sapiens
ggagcuguaguuuuucccacau

SEQ ID NO: 618 - RNA, 22 nt, Homo Sapiens
gcagagaggaaggcuaugaaac

SEQ ID NO: 619 - RNA, 22 nt, Homo Sapiens
gcagcaggcagggccaggcagg

SEQ ID NO: 620 - RNA, 22 nt, Homo Sapiens
guucacaguucagccuguaaca

SEQ ID NO: 621 - RNA, 22 nt, Homo Sapiens
uaagaagagaaagaagaggcug

SEQ ID NO: 622 - RNA, 22 nt, Homo Sapiens
ucugguuugagagacaaugaca

SEQ ID NO: 623 - RNA, 22 nt, Homo Sapiens
ucuuuuuguuguagcuguaugg

SEQ ID NO: 624 - RNA, 22 nt, Homo Sapiens
uccaaaauuaaagguuguagaa

SEQ ID NO: 625 - RNA, 22 nt, Homo Sapiens
ucagagugagucccugggacua

SEQ ID NO: 626 - RNA, 22 nt, Homo Sapiens
ucaguagcugucaaaacuggag

SEQ ID NO: 627 - RNA, 22 nt, Homo Sapiens
uccagggugggccucagacccu

SEQ ID NO: 628 - RNA, 22 nt, Homo Sapiens
uccagugaaacaggucucuuug

SEQ ID NO: 629 - RNA, 22 nt, Homo Sapiens
ugacuggaggaagggagguaag

SEQ ID NO: 630 - RNA, 22 nt, Homo Sapiens
ugaaaugcuuuuaggacacugc

SEQ ID NO: 631 - RNA, 22 nt, Homo Sapiens
uguggcagaaggcucuggauua

SEQ ID NO: 632 - RNA, 22 nt, Homo Sapiens
ugugcugguugcccccgagggg

SEQ ID NO: 633 - RNA, 22 nt, Homo Sapiens
ugguuaguuuuaugggccugga

SEQ ID NO: 634 - RNA, 22 nt, Homo Sapiens
uguaguuugaugcuagaacacu

SEQ ID NO: 635 - RNA, 22 nt, Homo Sapiens
uuaaugcuaaucgugauagggg

SEQ ID NO: 636 - RNA, 22 nt, Homo Sapiens
uuccagauggguaggaauaccu

SEQ ID NO: 637 - RNA, 22 nt, Homo Sapiens
uggagagauaagccaaguaucc

SEQ ID NO: 638 - RNA, 22 nt, Homo Sapiens
uggaaugaggaagggugugguc

SEQ ID NO: 639 - RNA, 22 nt, Homo Sapiens
uggagaauuaaaaaggguagug

SEQ ID NO: 640 - RNA, 22 nt, Homo Sapiens
ugcuagguuuuuuccuuucccc

SEQ ID NO: 641 - RNA, 22 nt, Homo Sapiens
ugguccagaggaggaaugaggg

SEQ ID NO: 642 - RNA, 22 nt, Homo Sapiens
uggucuccuauccuggcucaca

SEQ ID NO: 643 - RNA, 22 nt, Homo Sapiens
ugggcucgcucuucagucucgg

SEQ ID NO: 644 - RNA, 22 nt, Homo Sapiens
uggcacagaucagcagaacagg

SEQ ID NO: 645 - RNA, 22 nt, Homo Sapiens
uucaggcaccaggcacuuugcc

SEQ ID NO: 646 - RNA, 22 nt, Homo Sapiens
ugucuucauccaggaaccacau

SEQ ID NO: 647 - RNA, 21 nt, Homo Sapiens
ugugauaguucuuuuggaggc

SEQ ID NO: 648 - RNA, 22 nt, Homo Sapiens
uguguuggagcagaggcagggg

SEQ ID NO: 649 - RNA, 22 nt, Homo Sapiens
ugcagccuugaacucuuucugg

SEQ ID NO: 650 - RNA, 22 nt, Homo Sapiens
uccccagguucuaguccugagu

SEQ ID NO: 651 - RNA, 22 nt, Homo Sapiens
ucagagcagugccgaagcccag

SEQ ID NO: 652 - RNA, 22 nt, Homo Sapiens
ucaggcugaggucaucugcauc

SEQ ID NO: 653 - RNA, 22 nt, Homo Sapiens
ucuuccccaccuucggcuugca

SEQ ID NO: 654 - RNA, 22 nt, Homo Sapiens
ucugcuuggacugaucauugaa

SEQ ID NO: 655 - RNA, 22 nt, Homo Sapiens
guuuuguugucucuguguugua

SEQ ID NO: 656 - RNA, 22 nt, Homo Sapiens
gugugggcagggccgugcuccc

SEQ ID NO: 657 - RNA, 22 nt, Homo Sapiens
uaucucuugccuugaccuccua

SEQ ID NO: 658 - RNA, 22 nt, Homo Sapiens
gcagcaggcagggccaggcagg

SEQ ID NO: 659 - RNA, 22 nt, Homo Sapiens
ggaggaggaggcuggugcuggu

SEQ ID NO: 660 - RNA, 22 nt, Homo Sapiens
gguagcuagaggggagauagca

SEQ ID NO: 661 - RNA, 22 nt, Homo Sapiens
ggccugguggcuguuguuuugg

SEQ ID NO: 662 - RNA, 22 nt, Homo Sapiens
ggcccaggagggggagaaaggc

SEQ ID NO: 663 - RNA, 22 nt, Homo Sapiens
ggaguaugagagagaaugggac

SEQ ID NO: 664 - RNA, 22 nt, Homo Sapiens
ccccaccccaguggagcucacc

SEQ ID NO: 665 - RNA, 22 nt, Homo Sapiens
cagagcauuugugaggaguguu

SEQ ID NO: 666 - RNA, 22 nt, Homo Sapiens
cacugcacuccacccugggcaa

SEQ ID NO: 667 - RNA, 22 nt, Homo Sapiens
gagagagguagaggggagcaga

SEQ ID NO: 668 - RNA, 22 nt, Homo Sapiens
gaggagguggggcagcagcagg

SEQ ID NO: 669 - RNA, 22 nt, Homo Sapiens
cugggcucuggucuguagguuu

SEQ ID NO: 670 - RNA, 22 nt, Homo Sapiens
cugugagcuauuuguuuugguu

SEQ ID NO: 671 - RNA, 22 nt, Homo Sapiens
cugugcccagccagggcugugu

SEQ ID NO: 672 - RNA, 22 nt, Homo Sapiens
auaacugugaagaggcaauugu

SEQ ID NO: 673 - RNA, 22 nt, Homo Sapiens
auacugagagaaaaagcuuguc

SEQ ID NO: 674 - RNA, 22 nt, Homo Sapiens
auucaagauaagggucugggag

SEQ ID NO: 675 - RNA, 22 nt, Homo Sapiens
augggagacugaggggcggacg

SEQ ID NO: 676 - RNA, 22 nt, Homo Sapiens
aggggguuuagcuccacagggu

SEQ ID NO: 677 - RNA, 22 nt, Homo Sapiens
aggccagagaggacucucuuuu

SEQ ID NO: 678 - RNA, 22 nt, Homo Sapiens
uucuggugaauucaggauggua

SEQ ID NO: 679 - RNA, 22 nt, Homo Sapiens
uugcaaggaaggggaggaggcu

SEQ ID NO: 680 - RNA, 22 nt, Homo Sapiens
agguagggaggguagaugcucu

SEQ ID NO: 681 - RNA, 22 nt, Homo Sapiens
agagcuaggaagauacaggguu

SEQ ID NO: 682 - RNA, 22 nt, Homo Sapiens
agcuccaggagcuggcaggagg

SEQ ID NO: 683 - RNA, 22 nt, Homo Sapiens
auuuauuuucccucaaguaccu

SEQ ID NO: 684 - RNA, 22 nt, Homo Sapiens
ccuuguguuuuccagauucuga

SEQ ID NO: 685 - RNA, 22 nt, Homo Sapiens
ggccugaggucagcaguagagg

SEQ ID NO: 686 - RNA, 22 nt, Homo Sapiens
gugagaauggaggaagaacagu

SEQ ID NO: 687 - RNA, 22 nt, Homo Sapiens
gucuuccuccguccccaccucc

SEQ ID NO: 688 - RNA, 22 nt, Homo Sapiens
uccaaaaguggagaggaauaug

SEQ ID NO: 689 - RNA, 22 nt, Homo Sapiens
uuacaaaauuuggagggauugu

SEQ ID NO: 690 - RNA, 22 nt, Homo Sapiens
uggcucugugcuucuaguaucu

SEQ ID NO: 691 - RNA, 22 nt, Homo Sapiens
ucuuuuuguuguagcuguaugg

SEQ ID NO: 692 - RNA, 22 nt, Homo Sapiens
ugaaaugcuuuuaggacacugc

SEQ ID NO: 693 - RNA, 22 nt, Homo Sapiens
uaagaagagaaagaagaggcug

SEQ ID NO: 694 - RNA, 22 nt, Homo Sapiens
agcaagaugguagcauuggaga

SEQ ID NO: 695 - RNA, 22 nt, Homo Sapiens
uucugugcagguuaacauuucu

SEQ ID NO: 696 - RNA, 22 nt, Homo Sapiens
uuccugguggaggcauucggag

SEQ ID NO: 697 - RNA, 22 nt, Homo Sapiens
acacaucuaauggcugugcuga

SEQ ID NO: 698 - RNA, 22 nt, Homo Sapiens
cacacagucguguaguuuugcg

SEQ ID NO: 699 - RNA, 22 nt, Homo Sapiens
cuggcugcauuuaggaacaagg

SEQ ID NO: 700 - RNA, 22 nt, Homo Sapiens
guccuggagcuguuggagaaau

SEQ ID NO: 701 - RNA, 22 nt, Homo Sapiens
gcuucuccuguccccucccuac

SEQ ID NO: 702 - RNA, 22 nt, Homo Sapiens
ugugaaggaggaagggaggagc

SEQ ID NO: 703 - RNA, 22 nt, Homo Sapiens
uguaaacauccccgacuggaag

SEQ ID NO: 704 - RNA, 22 nt, Homo Sapiens
ugugagagaaauggcaaguugg

SEQ ID NO: 705 - RNA, 22 nt, Homo Sapiens
uggcucugucuauugggaugug

SEQ ID NO: 706 - RNA, 22 nt, Homo Sapiens
ugacuggaggaagggagguaag

SEQ ID NO: 707 - RNA, 22 nt, Homo Sapiens
ugcaugaugcugagguuuggga

SEQ ID NO: 708 - RNA, 22 nt, Homo Sapiens
gccucaguuguggccagggauu

SEQ ID NO: 709 - RNA, 22 nt, Homo Sapiens
gccuguaaucccagcuacuugg

SEQ ID NO: 710 - RNA, 22 nt, Homo Sapiens
gggggaucauuauaaaaauacu

SEQ ID NO: 711 - RNA, 22 nt, Homo Sapiens
gugagaauggaggaagaacagu

SEQ ID NO: 712 - RNA, 22 nt, Homo Sapiens
uacucauuuaugcauuguuuug

SEQ ID NO: 713 - RNA, 22 nt, Homo Sapiens
cugggauuacaggugugaacca

SEQ ID NO: 714 - RNA, 22 nt, Homo Sapiens
cucugccucccgggucuaggcu

SEQ ID NO: 715 - RNA, 22 nt, Homo Sapiens
cucugagucugagagaguaggu

SEQ ID NO: 716 - RNA, 22 nt, Homo Sapiens
cuggcuaauuuucuugaguuuu

SEQ ID NO: 717 - RNA, 22 nt, Homo Sapiens
gagguuugagccuucuccugcu

SEQ ID NO: 718 - RNA, 22 nt, Homo Sapiens
auuguaaauuaacaauuugcuc

SEQ ID NO: 719 - RNA, 22 nt, Homo Sapiens
aagcuggccuguaccugcugag

SEQ ID NO: 720 - RNA, 22 nt, Homo Sapiens
aaaggaguuugugacauugaca

SEQ ID NO: 721 - RNA, 22 nt, Homo Sapiens
augagaguaggaguuugggcuc

SEQ ID NO: 722 - RNA, 22 nt, Homo Sapiens
auaaagcuagacguucauugac

SEQ ID NO: 723 - RNA, 22 nt, Homo Sapiens
uuucauucauuucuuucaugga

SEQ ID NO: 724 - RNA, 22 nt, Homo Sapiens
uugugcuuguacugaccaugua

SEQ ID NO: 725 - RNA, 22 nt, Homo Sapiens
uucccuuaggucuggaauggua

SEQ ID NO: 726 - RNA, 22 nt, Homo Sapiens
uuuguaauagcaaaauacugga

SEQ ID NO: 727 - RNA, 22 nt, Homo Sapiens
aguuaugugaugcuuugaagca

SEQ ID NO: 728 - RNA, 22 nt, Homo Sapiens
aguaagcaaacucaguuuaauc

SEQ ID NO: 729 - RNA, 22 nt, Homo Sapiens
agggaguuuacauguuuucuaa

SEQ ID NO: 730 - RNA, 22 nt, Homo Sapiens
aggcuuuuggagaagcauaugc

SEQ ID NO: 731 - RNA, 22 nt, Homo Sapiens
aaaguggcuggaguggagucuu

SEQ ID NO: 732 - RNA, 22 nt, Homo Sapiens
aacugcuuuuguugugcaggga

SEQ ID NO: 733 - RNA, 22 nt, Homo Sapiens
aagcagaacuguuuuguuuucu

SEQ ID NO: 734 - RNA, 22 nt, Homo Sapiens
acagggcuaaggauguuugcug

SEQ ID NO: 735 - RNA, 22 nt, Homo Sapiens
caagugcuugaacauggcagag

SEQ ID NO: 736 - RNA, 22 nt, Homo Sapiens
cagugggaaaaguuugucucau

SEQ ID NO: 737 - RNA, 22 nt, Homo Sapiens
cccugggcugguguuugacuug

SEQ ID NO: 738 - RNA, 22 nt, Homo Sapiens
cauaucuccagguucugcugga

SEQ ID NO: 739 - RNA, 22 nt, Homo Sapiens
gaggaagguaaugaucuugauc

SEQ ID NO: 740 - RNA, 22 nt, Homo Sapiens
gaggagggcuuucccugacuuu

SEQ ID NO: 741 - RNA, 22 nt, Homo Sapiens
gagaugacugguggcugggggc

SEQ ID NO: 742 - RNA, 22 nt, Homo Sapiens
gaagcauugugagaaacagguu

SEQ ID NO: 743 - RNA, 22 nt, Homo Sapiens
gacaagaggcacagacagcagg

SEQ ID NO: 744 - RNA, 22 nt, Homo Sapiens
cucugccucccgggucuaggcu

SEQ ID NO: 745 - RNA, 22 nt, Homo Sapiens
uaggcagucucaguuguugggu

SEQ ID NO: 746 - RNA, 22 nt, Homo Sapiens
guggcaccauuggagucuaagg

SEQ ID NO: 747 - RNA, 22 nt, Homo Sapiens
ggcaaaaaaauagagcagaggg

SEQ ID NO: 748 - RNA, 21 nt, Homo Sapiens
gccuccauuucuacaucucua

SEQ ID NO: 749 - RNA, 22 nt, Homo Sapiens
ugaguauucaccaggugcuggg

SEQ ID NO: 750 - RNA, 22 nt, Homo Sapiens
ugagguuaguaguuugagacca

SEQ ID NO: 751 - RNA, 22 nt, Homo Sapiens
ucugccucccugucucacucuc

SEQ ID NO: 752 - RNA, 22 nt, Homo Sapiens
uccccaagccuuguaccagcgu

SEQ ID NO: 753 - RNA, 22 nt, Homo Sapiens
ugggaaaaaaggcaguuuagaa

SEQ ID NO: 754 - RNA, 21 nt, Homo Sapiens
ugugauaguucuuuuggaggc

SEQ ID NO: 755 - RNA, 22 nt, Homo Sapiens
uguguuggagcagaggcagggg

SEQ ID NO: 756 - RNA, 22 nt, Homo Sapiens
ugugaaggaggaagggaggagc

SEQ ID NO: 757 - RNA, 22 nt, Homo Sapiens
uguuaacauuuuggcuagauag

SEQ ID NO: 758 - RNA, 22 nt, Homo Sapiens
uggcaaagaaggcaguacaguu

SEQ ID NO: 759 - RNA, 22 nt, Homo Sapiens
ugaaaugcuuuuaggacacugc

SEQ ID NO: 760 - RNA, 22 nt, Homo Sapiens
ugagauggugucauauugcugg

SEQ ID NO: 761 - RNA, 22 nt, Homo Sapiens
ggaagaaugugcuuuuguuguu

SEQ ID NO: 762 - RNA, 22 nt, Homo Sapiens
gggggaucauuauaaaaauacu

SEQ ID NO: 763 - RNA, 22 nt, Homo Sapiens
guauguauuuauagauguucuu

SEQ ID NO: 764 - RNA, 22 nt, Homo Sapiens
uagggaaugaacaaauagaggc

SEQ ID NO: 765 - RNA, 22 nt, Homo Sapiens
cugccauuuccaggagaucacc

SEQ ID NO: 766 - RNA, 22 nt, Homo Sapiens
cugcagauuuugggguccacag

SEQ ID NO: 767 - RNA, 22 nt, Homo Sapiens
cuggcucccaggaggccucucu

SEQ ID NO: 768 - RNA, 22 nt, Homo Sapiens
ccguaaaauguucaaauguuuu

SEQ ID NO: 769 - RNA, 22 nt, Homo Sapiens
aguauuacagcagguacugguu

SEQ ID NO: 770 - RNA, 22 nt, Homo Sapiens
uuuuuaucuuuuucuccagaug

SEQ ID NO: 771 - RNA, 22 nt, Homo Sapiens
uugcccaggcuggagugcagug

SEQ ID NO: 772 - RNA, 22 nt, Homo Sapiens
uugcccaggcuagagugcagug

SEQ ID NO: 773 - RNA, 22 nt, Homo Sapiens
agugcagguucacaggcugggc

SEQ ID NO: 774 - RNA, 22 nt, Homo Sapiens
acauuuccaauguuuggggaca

SEQ ID NO: 775 - RNA, 22 nt, Homo Sapiens
ccccagucaaugcuucucucca

SEQ ID NO: 776 - RNA, 22 nt, Homo Sapiens
cugcugccuuucucucagagau

SEQ ID NO: 777 - RNA, 22 nt, Homo Sapiens
uagguugugcgcuccuuaugag

SEQ ID NO: 778 - RNA, 22 nt, Homo Sapiens
gugugggcagggccgugcuccc

SEQ ID NO: 779 - RNA, 22 nt, Homo Sapiens
ucuuggugcuuuugcuggauga

SEQ ID NO: 780 - RNA, 22 nt, Homo Sapiens
ucuggcuccugaguccuagcuc

SEQ ID NO: 781 - RNA, 22 nt, Homo Sapiens
ugcuaggcuuauucucuuccuc

SEQ ID NO: 782 - RNA, 22 nt, Homo Sapiens
uggagcagaaaggcaggagucc

SEQ ID NO: 783 - RNA, 22 nt, Homo Sapiens
uucagcauugccaguguuucca

SEQ ID NO: 784 - RNA, 22 nt, Homo Sapiens
ugguuaguuuuaugggccugga

SEQ ID NO: 785 - RNA, 22 nt, Homo Sapiens
ugugcugguugcccccgagggg

SEQ ID NO: 786 - RNA, 22 nt, Homo Sapiens
ugguggggagaggcuugggaag

SEQ ID NO: 787 - RNA, 22 nt, Homo Sapiens
ucuuggugcuuuugcuggauga

SEQ ID NO: 788 - RNA, 22 nt, Homo Sapiens
gucuggaggcuggaaccuggug

SEQ ID NO: 789 - RNA, 22 nt, Homo Sapiens
gguccacaaggggagagcaggg

SEQ ID NO: 790 - RNA, 22 nt, Homo Sapiens
ggagcuguaacagaucuguucu

SEQ ID NO: 791 - RNA, 20 nt, Homo Sapiens
acaggagcauggagaggcua

SEQ ID NO: 792 - RNA, 22 nt, Homo Sapiens
agugcagguucacaggcugggc

SEQ ID NO: 793 - RNA, 22 nt, Homo Sapiens
agauggaguugcaggugguccu

SEQ ID NO: 794 - RNA, 22 nt, Homo Sapiens
agcugagaaagcgaagaggugg

SEQ ID NO: 795 - RNA, 22 nt, Homo Sapiens
agagauaaagagguuuaggcag

SEQ ID NO: 796 - RNA, 22 nt, Homo Sapiens
aagucaccugaaaacucaacua

SEQ ID NO: 797 - RNA, 22 nt, Homo Sapiens
cugugagcuauuuguuuugguu

SEQ ID NO: 798 - RNA, 22 nt, Homo Sapiens
gacccuguguucaagguuaggg

SEQ ID NO: 799 - RNA, 22 nt, Homo Sapiens
gagguagagguugcagugaguc

SEQ ID NO: 800 - RNA, 22 nt, Homo Sapiens
cauaaaaucagaaaguauuacu

SEQ ID NO: 801 - RNA, 22 nt, Homo Sapiens
cacccucugccugugguugucu

SEQ ID NO: 802 - RNA, 22 nt, Homo Sapiens
ggaguaugagagagaaugggac

SEQ ID NO: 803 - RNA, 22 nt, Homo Sapiens
ggcaaggaagaaagcagaaguu

SEQ ID NO: 804 - RNA, 22 nt, Homo Sapiens
ggcaugugugagcagcugcagg

SEQ ID NO: 805 - RNA, 22 nt, Homo Sapiens
ggcugcagugaacuaugaucgu

SEQ ID NO: 806 - RNA, 22 nt, Homo Sapiens
ggaagaaugugcuuuuguuguu

SEQ ID NO: 807 - RNA, 22 nt, Homo Sapiens
gcaggugugcaaaucacaacuu

SEQ ID NO: 808 - RNA, 22 nt, Homo Sapiens
gucgggaggaaaagaaagaaga

SEQ ID NO: 809 - RNA, 22 nt, Homo Sapiens
guaacaaaaugaauaauaccug

SEQ ID NO: 810 - RNA, 22 nt, Homo Sapiens
guaaagaaaucauaaaagucca

SEQ ID NO: 811 - RNA, 22 nt, Homo Sapiens
ucccacagcuuccuagccacag

SEQ ID NO: 812 - RNA, 22 nt, Homo Sapiens
uccagggugggccucagacccu

SEQ ID NO: 813 - RNA, 22 nt, Homo Sapiens
ucccgugugaaaauuuguaugc

SEQ ID NO: 814 - RNA, 22 nt, Homo Sapiens
ugaaaugcuuuuaggacacugc

SEQ ID NO: 815 - RNA, 22 nt, Homo Sapiens
ugaguuuaagcuaagaagucug

SEQ ID NO: 816 - RNA, 22 nt, Homo Sapiens
uggaauugaguucccuggguuu

SEQ ID NO: 817 - RNA, 22 nt, Homo Sapiens
uugcaaggaaggggaggaggcu

SEQ ID NO: 818 - RNA, 22 nt, Homo Sapiens
uuugcagcuuccaaauuucuga

SEQ ID NO: 819 - RNA, 22 nt, Homo Sapiens
uggaggcaggugcagauggagg

SEQ ID NO: 820 - RNA, 22 nt, Homo Sapiens
uguguuggagcagaggcagggg

SEQ ID NO: 821 - RNA, 22 nt, Homo Sapiens
ugcgccccuguacucugggcaa

SEQ ID NO: 822 - RNA, 22 nt, Homo Sapiens
ucuggauuugagaggcuuuacu

SEQ ID NO: 823 - RNA, 22 nt, Homo Sapiens
guggcauuggugguggcauugg

SEQ ID NO: 824 - RNA, 22 nt, Homo Sapiens
guugggguuucaguggcaguca

SEQ ID NO: 825 - RNA, 22 nt, Homo Sapiens
ggaggcagugguugcagugagc

SEQ ID NO: 826 - RNA, 22 nt, Homo Sapiens
gcugcuccugcucucccucucc

SEQ ID NO: 827 - RNA, 22 nt, Homo Sapiens
gcuggguugagcugggcugaga

SEQ ID NO: 828 - RNA, 22 nt, Homo Sapiens
cggugcuguucaacagguccug

SEQ ID NO: 829 - RNA, 22 nt, Homo Sapiens
cauaucuccagguucugcugga

SEQ ID NO: 830 - RNA, 22 nt, Homo Sapiens
ccagccugagguuccuggaggg

SEQ ID NO: 831 - RNA, 22 nt, Homo Sapiens
ccacugcacuccagccugggug

SEQ ID NO: 832 - RNA, 22 nt, Homo Sapiens
ccaaagugcuaggauuacagcc

SEQ ID NO: 833 - RNA, 22 nt, Homo Sapiens
gagguuugagccuucuccugcu

SEQ ID NO: 834 - RNA, 22 nt, Homo Sapiens
gaggugaagaucuuggagucug

SEQ ID NO: 835 - RNA, 22 nt, Homo Sapiens
gagaggugaagccaggcuucug

SEQ ID NO: 836 - RNA, 22 nt, Homo Sapiens
gacaagaggcacagacagcagg

SEQ ID NO: 837 - RNA, 22 nt, Homo Sapiens
cuuggcccugugaggcuucacc

SEQ ID NO: 838 - RNA, 22 nt, Homo Sapiens
acacaggcccagagaggcagug

SEQ ID NO: 839 - RNA, 22 nt, Homo Sapiens
acugcacuccagccuggguggc

SEQ ID NO: 840 - RNA, 22 nt, Homo Sapiens
agugguuucagggacuucugua

SEQ ID NO: 841 - RNA, 22 nt, Homo Sapiens
cuggcucccucucuucucuccc

SEQ ID NO: 842 - RNA, 22 nt, Homo Sapiens
cugaauagaacagaagagcagc

SEQ ID NO: 843 - RNA, 22 nt, Homo Sapiens
gcugcuccugcucucccucucc

SEQ ID NO: 844 - RNA, 22 nt, Homo Sapiens
uguggcuuaggugagcauguga

SEQ ID NO: 845 - RNA, 22 nt, Homo Sapiens
uucaagaaagccaagauggcug

SEQ ID NO: 846 - RNA, 22 nt, Homo Sapiens
uguaaacaucccacacacucag

SEQ ID NO: 847 - RNA, 22 nt, Homo Sapiens
uggagccuuguuguuuguucac

SEQ ID NO: 848 - RNA, 22 nt, Homo Sapiens
ucugagcccaggaguuugaggc

SEQ ID NO: 849 - RNA, 22 nt, Homo Sapiens
gcagugaaggaggcaugugauc

SEQ ID NO: 850 - RNA, 22 nt, Homo Sapiens
guggcauuggugguggcauugg

SEQ ID NO: 851 - RNA, 22 nt, Homo Sapiens
guaaagaaaucauaaaagucca

SEQ ID NO: 852 - RNA, 22 nt, Homo Sapiens
uaggagugaaaauaaacucugu

SEQ ID NO: 853 - RNA, 22 nt, Homo Sapiens
uacaguucugguuucuucuuua

SEQ ID NO: 854 - RNA, 22 nt, Homo Sapiens
uaaguaaagagagaagccagaa

SEQ ID NO: 855 - RNA, 22 nt, Homo Sapiens
cugaauguaaucuuaguuguaa

SEQ ID NO: 856 - RNA, 22 nt, Homo Sapiens
cacacagucguguaguuuugcg

SEQ ID NO: 857 - RNA, 22 nt, Homo Sapiens
acugcagcuucagggacuugug

SEQ ID NO: 858 - RNA, 22 nt, Homo Sapiens
uuugcacacuuuccaaguugcc

SEQ ID NO: 859 - RNA, 22 nt, Homo Sapiens
uucuuuuuccgcuuucugagcc

SEQ ID NO: 860 - RNA, 22 nt, Homo Sapiens
uugugcuuguacugaccaugua

SEQ ID NO: 861 - RNA, 22 nt, Homo Sapiens
uugucagaggcugguagggugu

SEQ ID NO: 862 - RNA, 22 nt, Homo Sapiens
uucugccacugcauuccagccu

SEQ ID NO: 863 - RNA, 22 nt, Homo Sapiens
uuugcacuguaauaccucgguc

SEQ ID NO: 864 - RNA, 22 nt, Homo Sapiens
acacaggcccagagaggcagug

SEQ ID NO: 865 - RNA, 22 nt, Homo Sapiens
aaucccagcuacucgggaggcu

SEQ ID NO: 866 - RNA, 22 nt, Homo Sapiens
aaaggaguuugugacauugaca

SEQ ID NO: 867 - RNA, 22 nt, Homo Sapiens
agugcagguucacaggcugggc

SEQ ID NO: 868 - RNA, 22 nt, Homo Sapiens
agcugugagccugccuuccagu

SEQ ID NO: 869 - RNA, 22 nt, Homo Sapiens
aggcugagugacugggaguuag

SEQ ID NO: 870 - RNA, 22 nt, Homo Sapiens
aggcaagagguugcagugagcu

SEQ ID NO: 871 - RNA, 22 nt, Homo Sapiens
cacugcacuccagccuggguga

SEQ ID NO: 872 - RNA, 22 nt, Homo Sapiens
cacugcacuccagccugggcga

SEQ ID NO: 873 - RNA, 22 nt, Homo Sapiens
cacugcacuccagccuaggcaa

SEQ ID NO: 874 - RNA, 22 nt, Homo Sapiens
cacugcacucuagccucgguga

SEQ ID NO: 875 - RNA, 22 nt, Homo Sapiens
cacugcacuguagccuccuggg

SEQ ID NO: 876 - RNA, 22 nt, Homo Sapiens
ccacugcacuccagccugggug

SEQ ID NO: 877 - RNA, 22 nt, Homo Sapiens
ccacugcacuccagcacuccag

SEQ ID NO: 878 - RNA, 22 nt, Homo Sapiens
ccagccugagguuccuggaggg

SEQ ID NO: 879 - RNA, 22 nt, Homo Sapiens
cggcaagaugccggagugcugg

SEQ ID NO: 880 - RNA, 21 nt, Homo Sapiens
gacacaggcccagagaggcag

SEQ ID NO: 881 - RNA, 22 nt, Homo Sapiens
gccauugcacuccagccuggac

SEQ ID NO: 882 - RNA, 22 nt, Homo Sapiens
gccauugcacuccagccugggc

SEQ ID NO: 883 - RNA, 22 nt, Homo Sapiens
ggcugggcaugguggcucacgc

SEQ ID NO: 884 - RNA, 22 nt, Homo Sapiens
ugcaccacuacacuccuaggca

SEQ ID NO: 885 - RNA, 22 nt, Homo Sapiens
ugcaccacugcacucuaaccug

SEQ ID NO: 886 - RNA, 22 nt, Homo Sapiens
ugcaccacugcacuccagccug

SEQ ID NO: 887 - RNA, 22 nt, Homo Sapiens
ugagggggaaggugugugugug

SEQ ID NO: 888 - RNA, 22 nt, Homo Sapiens
uggaaagcauguacauuuggag

SEQ ID NO: 889 - RNA, 22 nt, Homo Sapiens
uguaaacuugucuugaauggaa

SEQ ID NO: 890 - RNA, 22 nt, Homo Sapiens
uggggcacuguggaggugucau

SEQ ID NO: 891 - RNA, 22 nt, Homo Sapiens
cuguccugugucagccugaaau

SEQ ID NO: 892 - RNA, 22 nt, Homo Sapiens
augggcaaauacugggagcugg

SEQ ID NO: 893 - RNA, 22 nt, Homo Sapiens
aagcuggccuguaccugcugag

SEQ ID NO: 894 - RNA, 22 nt, Homo Sapiens
aaucuccauuuguaaaugugac

SEQ ID NO: 895 - RNA, 22 nt, Homo Sapiens
acugcacuccauccugggacag

SEQ ID NO: 896 - RNA, 22 nt, Homo Sapiens
agcuccaggagcuggcaggagg

SEQ ID NO: 897 - RNA, 21 nt, Homo Sapiens
cuuuggcaagggagaagucac

SEQ ID NO: 898 - RNA, 22 nt, Homo Sapiens
ccaaagugcuggcguuacaggu

SEQ ID NO: 899 - RNA, 22 nt, Homo Sapiens
cacugcacuccagccugggcga

SEQ ID NO: 900 - RNA, 22 nt, Homo Sapiens
cacugcacuccagccuggguga

SEQ ID NO: 901 - RNA, 22 nt, Homo Sapiens
uggaagaauaggcaguauugga

SEQ ID NO: 902 - RNA, 22 nt, Homo Sapiens
uggagagaaagcgaagauguag

SEQ ID NO: 903 - RNA, 22 nt, Homo Sapiens
uggagagauaagccaaguaucc

SEQ ID NO: 904 - RNA, 22 nt, Homo Sapiens
uggagagagcagguugcuaaga

SEQ ID NO: 905 - RNA, 22 nt, Homo Sapiens
uucaggacugucuggauuuauu

SEQ ID NO: 906 - RNA, 22 nt, Homo Sapiens
ugcaaguugucuucuagggugu

SEQ ID NO: 907 - RNA, 22 nt, Homo Sapiens
uccaaagacucaacaguuagac

SEQ ID NO: 908 - RNA, 22 nt, Homo Sapiens
gguccacaaggggagagcaggg

SEQ ID NO: 909 - RNA, 22 nt, Homo Sapiens
gaguuaagcaaagagaggaaga

SEQ ID NO: 910 - RNA, 22 nt, Homo Sapiens
ucacugcaaccucugcuucugg

SEQ ID NO: 911 - RNA, 22 nt, Homo Sapiens
ucacccaguguaaacagcauga

SEQ ID NO: 912 - RNA, 22 nt, Homo Sapiens
uaaggcacugcuucuaaguagg

SEQ ID NO: 913 - RNA, 22 nt, Homo Sapiens
uagacugaggcuuccugcaggg

SEQ ID NO: 914 - RNA, 22 nt, Homo Sapiens
guccagugcucacugccgacau

SEQ ID NO: 915 - RNA, 22 nt, Homo Sapiens
guggcauuggugguggcauugg

SEQ ID NO: 916 - RNA, 22 nt, Homo Sapiens
gcaggcugguuggugaggcaaa

SEQ ID NO: 917 - RNA, 22 nt, Homo Sapiens
gcccaggagucugaggcuggag

SEQ ID NO: 918 - RNA, 22 nt, Homo Sapiens
gcagugaaggaggcaugugauc

SEQ ID NO: 919 - RNA, 22 nt, Homo Sapiens
gccuggaugugaccacccucac

SEQ ID NO: 920 - RNA, 22 nt, Homo Sapiens
gcugaauuuugacuccaucucc

SEQ ID NO: 921 - RNA, 22 nt, Homo Sapiens
gcuucuccuguccccucccuac

SEQ ID NO: 922 - RNA, 22 nt, Homo Sapiens
gcuguguuaacuguucaaacuc

SEQ ID NO: 923 - RNA, 22 nt, Homo Sapiens
ggaaaacaaguaccccuggaac

SEQ ID NO: 924 - RNA, 22 nt, Homo Sapiens
gggccaugacagggagauaggc

SEQ ID NO: 925 - RNA, 22 nt, Homo Sapiens
ggcccaggagggggagaaaggc

SEQ ID NO: 926 - RNA, 22 nt, Homo Sapiens
ggcaugauggagaggguggaga

SEQ ID NO: 927 - RNA, 22 nt, Homo Sapiens
ucccuuugaagccagguuccag

SEQ ID NO: 928 - RNA, 22 nt, Homo Sapiens
ucacuugccuagggucacacag

SEQ ID NO: 929 - RNA, 22 nt, Homo Sapiens
ucuggauuugagaggcuuuacu

SEQ ID NO: 930 - RNA, 22 nt, Homo Sapiens
ucugguuugagagacaaugaca

SEQ ID NO: 931 - RNA, 22 nt, Homo Sapiens
ucugucauuuuucucuuuccau

SEQ ID NO: 932 - RNA, 22 nt, Homo Sapiens
ugauggaggaaauggugguauc

SEQ ID NO: 933 - RNA, 22 nt, Homo Sapiens
ugagggaggaaguuugggauga

SEQ ID NO: 934 - RNA, 22 nt, Homo Sapiens
ugacuggaggaagggagguaag

SEQ ID NO: 935 - RNA, 22 nt, Homo Sapiens
ugagagaggaaggccguaggga

SEQ ID NO: 936 - RNA, 22 nt, Homo Sapiens
uucacccaucuuuccacccacg

SEQ ID NO: 937 - RNA, 21 nt, Homo Sapiens
uucacccaucuuuccacccac

SEQ ID NO: 938 - RNA, 22 nt, Homo Sapiens
ugugaaggaggaagggaggagc

SEQ ID NO: 939 - RNA, 22 nt, Homo Sapiens
ugucuucauccaggaaccacau

SEQ ID NO: 940 - RNA, 22 nt, Homo Sapiens
uguggcagaaggcucuggauua

SEQ ID NO: 941 - RNA, 22 nt, Homo Sapiens
uggagugucuggaggugucucu

SEQ ID NO: 942 - RNA, 22 nt, Homo Sapiens
ugguggggagaggcuugggaag

SEQ ID NO: 943 - RNA, 22 nt, Homo Sapiens
ugguccagaggaggaaugaggg

SEQ ID NO: 944 - RNA, 22 nt, Homo Sapiens
uggaaugacagaagaugagagc

SEQ ID NO: 945 - RNA, 22 nt, Homo Sapiens
uggauuaguaaagaagaaugaa

SEQ ID NO: 946 - RNA, 22 nt, Homo Sapiens
cacccucugccugugguugucu

SEQ ID NO: 947 - RNA, 22 nt, Homo Sapiens
ccagccugagguuccuggaggg

SEQ ID NO: 948 - RNA, 22 nt, Homo Sapiens
cuuuggccacggggauaugaau

SEQ ID NO: 949 - RNA, 22 nt, Homo Sapiens
cuuuuccugggucugggcugug

SEQ ID NO: 950 - RNA, 22 nt, Homo Sapiens
gagaugacugguggcugggggc

SEQ ID NO: 951 - RNA, 22 nt, Homo Sapiens
gaguacaaaugaagucuguggg

SEQ ID NO: 952 - RNA, 22 nt, Homo Sapiens
cugcccugaacucuggccaucc

SEQ ID NO: 953 - RNA, 22 nt, Homo Sapiens
cuuggcccugugaggcuucacc

SEQ ID NO: 954 - RNA, 22 nt, Homo Sapiens
aggcaagagguugcagugagcu

SEQ ID NO: 955 - RNA, 22 nt, Homo Sapiens
aggcagguggguguaugggucu

SEQ ID NO: 956 - RNA, 22 nt, Homo Sapiens
aggcugagugcaguggugugau

SEQ ID NO: 957 - RNA, 22 nt, Homo Sapiens
agguggaguuuugcuuucccau

SEQ ID NO: 958 - RNA, 22 nt, Homo Sapiens
accaucuucccuuucucgagua

SEQ ID NO: 959 - RNA, 22 nt, Homo Sapiens
acugcagcuucagggacuugug

SEQ ID NO: 960 - RNA, 22 nt, Homo Sapiens
aagguggugucauguuuugggg

SEQ ID NO: 961 - RNA, 22 nt, Homo Sapiens
aaaguguguuaucuagguaguc

SEQ ID NO: 962 - RNA, 22 nt, Homo Sapiens
aaaggcagacggugaaugccuu

SEQ ID NO: 963 - RNA, 22 nt, Homo Sapiens
aaugugcauggaucgcucagaa

SEQ ID NO: 964 - RNA, 22 nt, Homo Sapiens
acaaccucugccuccuggguuc

SEQ ID NO: 965 - RNA, 22 nt, Homo Sapiens
acugcacuccaaccaggcugac

SEQ ID NO: 966 - RNA, 22 nt, Homo Sapiens
aucacuauuaaugugugcuagu

SEQ ID NO: 967 - RNA, 22 nt, Homo Sapiens
auaccagcacaguggaugggga

SEQ ID NO: 968 - RNA, 22 nt, Homo Sapiens
agguagggaggguagaugcucu

SEQ ID NO: 969 - RNA, 22 nt, Homo Sapiens
aggccuuuuugggaagagacag

SEQ ID NO: 970 - RNA, 22 nt, Homo Sapiens
aggcaguaagggagaguuuugc

SEQ ID NO: 971 - RNA, 22 nt, Homo Sapiens
cuggcucccucucuucucuccc

SEQ ID NO: 972 - RNA, 22 nt, Homo Sapiens
cuggcugcauuuaggaacaagg

SEQ ID NO: 973 - RNA, 22 nt, Homo Sapiens
cuggaagacaugguagagcuga

SEQ ID NO: 974 - RNA, 22 nt, Homo Sapiens
cugaauagaacagaagagcagc

SEQ ID NO: 975 - RNA, 22 nt, Homo Sapiens
gagguagagguugcagugaguc

SEQ ID NO: 976 - RNA, 22 nt, Homo Sapiens
gagagagguagaggggagcaga

SEQ ID NO: 977 - RNA, 22 nt, Homo Sapiens
gagaaguaggaauaucaggagu

SEQ ID NO: 978 - RNA, 21 nt, Homo Sapiens
gacacaggcccagagaggcag

SEQ ID NO: 979 - RNA, 22 nt, Homo Sapiens
ccagccugagguuccuggaggg

SEQ ID NO: 980 - RNA, 22 nt, Homo Sapiens
ccccagucaaugcuucucucca

SEQ ID NO: 981 - RNA, 22 nt, Homo Sapiens
cacagcauuggucaugagguca

SEQ ID NO: 982 - RNA, 22 nt, Homo Sapiens
cagguggugcuguuaagaagca

SEQ ID NO: 983 - RNA, 22 nt, Homo Sapiens
cagagcugccuuucccuuccug

SEQ ID NO: 984 - RNA, 22 nt, Homo Sapiens
uggauuaguaaagaagaaugaa

SEQ ID NO: 985 - RNA, 22 nt, Homo Sapiens
ugggaggcuacacguuucucca

SEQ ID NO: 986 - RNA, 22 nt, Homo Sapiens
uggaggcaggugcagauggagg

SEQ ID NO: 987 - RNA, 22 nt, Homo Sapiens
uggagcagaaaggcaggagucc

SEQ ID NO: 988 - RNA, 22 nt, Homo Sapiens
uggaagaauaggcaguauugga

SEQ ID NO: 989 - RNA, 22 nt, Homo Sapiens
uucacaguggcugaagcuguuc

SEQ ID NO: 990 - RNA, 22 nt, Homo Sapiens
uuaacugagaggaucugaguag

SEQ ID NO: 991 - RNA, 22 nt, Homo Sapiens
uuaaagaucacuugacauggac

SEQ ID NO: 992 - RNA, 22 nt, Homo Sapiens
ugaaaagccuuuggguagugau

SEQ ID NO: 993 - RNA, 22 nt, Homo Sapiens
ugcaaguugucuucuagggugu

SEQ ID NO: 994 - RNA, 22 nt, Homo Sapiens
ugcagauacauguguaacugaa

SEQ ID NO: 995 - RNA, 22 nt, Homo Sapiens
ucugagcccaggaguuugaggc

SEQ ID NO: 996 - RNA, 22 nt, Homo Sapiens
ggcaugauggagaggguggaga

SEQ ID NO: 997 - RNA, 22 nt, Homo Sapiens
ggcagcugugcagagugggggu

SEQ ID NO: 998 - RNA, 22 nt, Homo Sapiens
gguccacaaggggagagcaggg

SEQ ID NO: 999 - RNA, 22 nt, Homo Sapiens
gucaccaggcagaauucagaua

SEQ ID NO: 1000 - RNA, 22 nt, Homo Sapiens
uagacugaggcuuccugcaggg

SEQ ID NO: 1001 - RNA, 22 nt, Homo Sapiens
uagcucauuuuugaaaucaguu

SEQ ID NO: 1002 - RNA, 22 nt, Homo Sapiens
uacaggcaggcacagaggcagu

SEQ ID NO: 1003 - RNA, 22 nt, Homo Sapiens
ucaaagcugcagauugccugug

SEQ ID NO: 1004 - RNA, 22 nt, Homo Sapiens
uuuguguccugacccagaggac

SEQ ID NO: 1005 - RNA, 22 nt, Homo Sapiens
uugucagaggcugguagggugu

SEQ ID NO: 1006 - RNA, 22 nt, Homo Sapiens
uuuggggucuccccagcaugca

SEQ ID NO: 1007 - RNA, 22 nt, Homo Sapiens
ucaacuaugauuaccaaagcag

SEQ ID NO: 1008 - RNA, 22 nt, Homo Sapiens
uagacugaggcuuccugcaggg

SEQ ID NO: 1009 - RNA, 22 nt, Homo Sapiens
uagcugccaggcaacaaguacg

SEQ ID NO: 1010 - RNA, 22 nt, Homo Sapiens
guaacaaaaugaauaauaccug

SEQ ID NO: 1011 - RNA, 22 nt, Homo Sapiens
ggcaccaucucagcucacugga

SEQ ID NO: 1012 - RNA, 22 nt, Homo Sapiens
uccuuuggacaugggcaagggu

SEQ ID NO: 1013 - RNA, 22 nt, Homo Sapiens
ugauucauuucuaaacccagcu

SEQ ID NO: 1014 - RNA, 22 nt, Homo Sapiens
ugauuguccaaacgcaauucuu

SEQ ID NO: 1015 - RNA, 22 nt, Homo Sapiens
ugagguuaguaguuugagacca

SEQ ID NO: 1016 - RNA, 21 nt, Homo Sapiens
ugagguaggugcugaaacugc

SEQ ID NO: 1017 - RNA, 22 nt, Homo Sapiens
ugagguaggugcugaaacugcu

SEQ ID NO: 1018 - RNA, 22 nt, Homo Sapiens
uguagugugaaaggcauagugu

SEQ ID NO: 1019 - RNA, 22 nt, Homo Sapiens
uggucucuugaaagaggcucuu

SEQ ID NO: 1020 - RNA, 22 nt, Homo Sapiens
uggcacagaucagcagaacagg

SEQ ID NO: 1021 - RNA, 22 nt, Homo Sapiens
ccugggggccacuuugcacagg

SEQ ID NO: 1022 - RNA, 22 nt, Homo Sapiens
gaccagccauccugguuuacau

SEQ ID NO: 1023 - RNA, 22 nt, Homo Sapiens
gaacagcuccagucuacagccc

SEQ ID NO: 1024 - RNA, 22 nt, Homo Sapiens
gagcagguuuggaauggcucca

SEQ ID NO: 1025 - RNA, 22 nt, Homo Sapiens
gauuccuccucuuuaaaauggu

SEQ ID NO: 1026 - RNA, 22 nt, Homo Sapiens
cugcacuagaaggcacuauguu

SEQ ID NO: 1027 - RNA, 22 nt, Homo Sapiens
agcugguguguagcggguaccu

SEQ ID NO: 1028 - RNA, 22 nt, Homo Sapiens
agcaaguguugaaacagcuggu

SEQ ID NO: 1029 - RNA, 22 nt, Homo Sapiens
accaucuucccuuucucgagua

SEQ ID NO: 1030 - RNA, 22 nt, Homo Sapiens
ugcagcagaccuuuugccuucu

SEQ ID NO: 1031 - RNA, 22 nt, Homo Sapiens
gcugcuccugcucucccucucc

SEQ ID NO: 1032 - RNA, 22 nt, Homo Sapiens
ggaagaaugugcuuuuguuguu

SEQ ID NO: 1033 - RNA, 22 nt, Homo Sapiens
ggaauggauggaagugugugag

SEQ ID NO: 1034 - RNA, 22 nt, Homo Sapiens
ggaggcagugguugcagugagc

SEQ ID NO: 1035 - RNA, 22 nt, Homo Sapiens
gcugcuccugcucucccucucc

SEQ ID NO: 1036 - RNA, 22 nt, Homo Sapiens
gccuguaaucccagcuacuugg

SEQ ID NO: 1037 - RNA, 22 nt, Homo Sapiens
gccauugcacuccagccuggac

SEQ ID NO: 1038 - RNA, 22 nt, Homo Sapiens
gccauugcacuccagccugggc

SEQ ID NO: 1039 - RNA, 22 nt, Homo Sapiens
gcacucaagccuggguuacaga

SEQ ID NO: 1040 - RNA, 22 nt, Homo Sapiens
ggcaaggaagaaagcagaaguu

SEQ ID NO: 1041 - RNA, 22 nt, Homo Sapiens
ggcugcagugaacuaugaucgu

SEQ ID NO: 1042 - RNA, 22 nt, Homo Sapiens
guacuccagccugccuggguaa

SEQ ID NO: 1043 - RNA, 22 nt, Homo Sapiens
uauugcacuccagccugggcaa

SEQ ID NO: 1044 - RNA, 22 nt, Homo Sapiens
uaguaguuagaggcugcaguga

SEQ ID NO: 1045 - RNA, 22 nt, Homo Sapiens
ugcaccacugcacucuaaccug

SEQ ID NO: 1046 - RNA, 22 nt, Homo Sapiens
ugcaccaaugcacuccagccug

SEQ ID NO: 1047 - RNA, 22 nt, Homo Sapiens
ugcaccacugcacuccagccug

SEQ ID NO: 1048 - RNA, 22 nt, Homo Sapiens
ugaguguaugugugagagagaa

SEQ ID NO: 1049 - RNA, 22 nt, Homo Sapiens
ugcaagucugugauuuuguguu

SEQ ID NO: 1050 - RNA, 22 nt, Homo Sapiens
ugagaucaucguuacaagcagc

SEQ ID NO: 1051 - RNA, 22 nt, Homo Sapiens
uccauugcacuccagucugggc

SEQ ID NO: 1052 - RNA, 22 nt, Homo Sapiens
ucauccuuuucugcaaccuguu

SEQ ID NO: 1053 - RNA, 22 nt, Homo Sapiens
ucuuugaucucuuccggggcuu

SEQ ID NO: 1054 - RNA, 22 nt, Homo Sapiens
uggcuguuugggguugccgugu

SEQ ID NO: 1055 - RNA, 22 nt, Homo Sapiens
ugucuggaggcgcaguuuucag

SEQ ID NO: 1056 - RNA, 22 nt, Homo Sapiens
ugugccacugcacuccaugggu

SEQ ID NO: 1057 - RNA, 22 nt, Homo Sapiens
acugcacuccaaccaggcugac

SEQ ID NO: 1058 - RNA, 22 nt, Homo Sapiens
acugcacuccagccuaugggau

SEQ ID NO: 1059 - RNA, 22 nt, Homo Sapiens
accugcauuccagccugcugac

SEQ ID NO: 1060 - RNA, 22 nt, Homo Sapiens
acugcacuccauccugggacag

SEQ ID NO: 1061 - RNA, 22 nt, Homo Sapiens
acugcacuccauccugagugac

SEQ ID NO: 1062 - RNA, 22 nt, Homo Sapiens
acugcacuccagucugggugac

SEQ ID NO: 1063 - RNA, 22 nt, Homo Sapiens
acugcacuccagccuguugaca

SEQ ID NO: 1064 - RNA, 22 nt, Homo Sapiens
acugcacuccagucuaggugac

SEQ ID NO: 1065 - RNA, 22 nt, Homo Sapiens
acugcacuccagccuggguggc

SEQ ID NO: 1066 - RNA, 22 nt, Homo Sapiens
acugcacuccagccugggugac

SEQ ID NO: 1067 - RNA, 22 nt, Homo Sapiens
acugcacuccagccugggugau

SEQ ID NO: 1068 - RNA, 22 nt, Homo Sapiens
acugcacuccagccugggcgau

SEQ ID NO: 1069 - RNA, 22 nt, Homo Sapiens
acugcacuccagccuggcgaca

SEQ ID NO: 1070 - RNA, 22 nt, Homo Sapiens
acugcacucuagccugagcaac

SEQ ID NO: 1071 - RNA, 22 nt, Homo Sapiens
acugcacuucagccugggcaau

SEQ ID NO: 1072 - RNA, 22 nt, Homo Sapiens
acugcacucuagccugggcaac

SEQ ID NO: 1073 - RNA, 22 nt, Homo Sapiens
acugcacuccauccuggggagc

SEQ ID NO: 1074 - RNA, 22 nt, Homo Sapiens
acugcacuccugccuaggugac

SEQ ID NO: 1075 - RNA, 22 nt, Homo Sapiens
acugcacuccugccugggugac

SEQ ID NO: 1076 - RNA, 22 nt, Homo Sapiens
acugcacucuagccuaggugau

SEQ ID NO: 1077 - RNA, 22 nt, Homo Sapiens
acuguacuccacccugggcgac

SEQ ID NO: 1078 - RNA, 22 nt, Homo Sapiens
acuguacuccagccugggcaac

SEQ ID NO: 1079 - RNA, 22 nt, Homo Sapiens
acuguacuucagccugggcaac

SEQ ID NO: 1080 - RNA, 22 nt, Homo Sapiens
acuguacuccagccuaggcaac

SEQ ID NO: 1081 - RNA, 22 nt, Homo Sapiens
acuguacuccagccugggugac

SEQ ID NO: 1082 - RNA, 22 nt, Homo Sapiens
acuguacuucagccuggguaac

SEQ ID NO: 1083 - RNA, 22 nt, Homo Sapiens
acagcaguccagccugggugac

SEQ ID NO: 1084 - RNA, 22 nt, Homo Sapiens
aaucccagcuacucgggaggcu

SEQ ID NO: 1085 - RNA, 22 nt, Homo Sapiens
aaauccuggggaucuggaggga

SEQ ID NO: 1086 - RNA, 22 nt, Homo Sapiens
agauaguucucuguuguugggg

SEQ ID NO: 1087 - RNA, 22 nt, Homo Sapiens
aggcaagagguugcagugagcu

SEQ ID NO: 1088 - RNA, 22 nt, Homo Sapiens
agugagcuaugaucaugccggu

SEQ ID NO: 1089 - RNA, 22 nt, Homo Sapiens
auugcacuucagccugggugac

SEQ ID NO: 1090 - RNA, 22 nt, Homo Sapiens
auugcacuccagcuugggcaac

SEQ ID NO: 1091 - RNA, 22 nt, Homo Sapiens
auugcacuccagccugggugac

SEQ ID NO: 1092 - RNA, 22 nt, Homo Sapiens
auugcacuccagccugggcaau

SEQ ID NO: 1093 - RNA, 22 nt, Homo Sapiens
auggccuuuucucuuauccugg

SEQ ID NO: 1094 - RNA, 22 nt, Homo Sapiens
cucagauacuugggagguugag

SEQ ID NO: 1095 - RNA, 22 nt, Homo Sapiens
cugggcgugugaggcggcugug

SEQ ID NO: 1096 - RNA, 22 nt, Homo Sapiens
cuugcacuccacagccugggug

SEQ ID NO: 1097 - RNA, 22 nt, Homo Sapiens
gagguagagguugcagugagug

SEQ ID NO: 1098 - RNA, 22 nt, Homo Sapiens
gaggagguggggcagcagcagg

SEQ ID NO: 1099 - RNA, 22 nt, Homo Sapiens
gagguagagguugcagugaguc

SEQ ID NO: 1100 - RNA, 22 nt, Homo Sapiens
cguguaaucccagcuacuuggg

SEQ ID NO: 1101 - RNA, 22 nt, Homo Sapiens
ccacugcacuccagcacuccag

SEQ ID NO: 1102 - RNA, 22 nt, Homo Sapiens
ccacugcacuccagccugggug

SEQ ID NO: 1103 - RNA, 22 nt, Homo Sapiens
cauugcacuccagccuggguga

SEQ ID NO: 1104 - RNA, 22 nt, Homo Sapiens
cauugcacuccacccuaggcaa

SEQ ID NO: 1105 - RNA, 22 nt, Homo Sapiens
cauugcacuccagccuaggcaa

SEQ ID NO: 1106 - RNA, 22 nt, Homo Sapiens
cacugcacuccagccuggguga

SEQ ID NO: 1107 - RNA, 22 nt, Homo Sapiens
cacugcacuccagccuggguaa

SEQ ID NO: 1108 - RNA, 22 nt, Homo Sapiens
cacugcacuccagccugggcga

SEQ ID NO: 1109 - RNA, 22 nt, Homo Sapiens
cacugcacuccagccuaggcaa

SEQ ID NO: 1110 - RNA, 22 nt, Homo Sapiens
cacugcacuguagccuccuggg

SEQ ID NO: 1111 - RNA, 22 nt, Homo Sapiens
cacugcacucuagccucgguga

SEQ ID NO: 1112 - RNA, 22 nt, Homo Sapiens
cacugcacuccaaccuggacaa

SEQ ID NO: 1113 - RNA, 22 nt, Homo Sapiens
cacugcacuccacccugggcaa

SEQ ID NO: 1114 - RNA, 22 nt, Homo Sapiens
cacugcacuccagcccggcaac

SEQ ID NO: 1115 - RNA, 22 nt, Homo Sapiens
cacugcacucagccugggugac

SEQ ID NO: 1116 - RNA, 22 nt, Homo Sapiens
auuguucuccagccugggcgac

SEQ ID NO: 1117 - RNA, 22 nt, Homo Sapiens
uucugccacugcauuccagccu

SEQ ID NO: 1118 - RNA, 22 nt, Homo Sapiens
uugcacuccagucugggugaca

SEQ ID NO: 1119 - RNA, 22 nt, Homo Sapiens
uugcacuccagccugggugaca

SEQ ID NO: 1120 - RNA, 22 nt, Homo Sapiens
uugcacuccagccuggguaaca

SEQ ID NO: 1121 - RNA, 22 nt, Homo Sapiens
uuccuucugcauugugagaaaa

SEQ ID NO: 1122 - RNA, 22 nt, Homo Sapiens
uugcccaggcuggagugcagug

SEQ ID NO: 1123 - RNA, 22 nt, Homo Sapiens
cacccaggcuggagugcagugg

SEQ ID NO: 1124 - RNA, 22 nt, Homo Sapiens
cgacucuugaccauggcugggg

SEQ ID NO: 1125 - RNA, 22 nt, Homo Sapiens
ccuccuuucaucaaauucgagu

SEQ ID NO: 1126 - RNA, 22 nt, Homo Sapiens
ccaggguacucugggaucacuu

SEQ ID NO: 1127 - RNA, 22 nt, Homo Sapiens
cccaggcuggagugcaguggug

SEQ ID NO: 1128 - RNA, 21 nt, Homo Sapiens
cuuuggcaagggagaagucac

SEQ ID NO: 1129 - RNA, 22 nt, Homo Sapiens
cuucuuuggggugggcuugcuc

SEQ ID NO: 1130 - RNA, 22 nt, Homo Sapiens
cuggcucccucucuucucuccc

SEQ ID NO: 1131 - RNA, 22 nt, Homo Sapiens
cugcugccuuucucucagagau

SEQ ID NO: 1132 - RNA, 22 nt, Homo Sapiens
augcccuuccucuucugccaug

SEQ ID NO: 1133 - RNA, 22 nt, Homo Sapiens
aaccugucauuccaaggacagu

SEQ ID NO: 1134 - RNA, 22 nt, Homo Sapiens
agaaguguaaauaaguauguau

SEQ ID NO: 1135 - RNA, 22 nt, Homo Sapiens
ugugacacguucauucugcaag

SEQ ID NO: 1136 - RNA, 22 nt, Homo Sapiens
uggaauggcugaagacugugaa

SEQ ID NO: 1137 - RNA, 22 nt, Homo Sapiens
ucugguuuuaauccugaaggca

SEQ ID NO: 1138 - RNA, 22 nt, Homo Sapiens
ucacuguuccuuuuuguugaga

SEQ ID NO: 1139 - RNA, 22 nt, Homo Sapiens
ucagucguuucucucucccagc

SEQ ID NO: 1140 - RNA, 22 nt, Homo Sapiens
uccauugcacuccagucugggc

SEQ ID NO: 1141 - RNA, 22 nt, Homo Sapiens
ugagaugaaccagguaucucag

SEQ ID NO: 1142 - RNA, 22 nt, Homo Sapiens
ugaaaugcuuuuaggacacugc

SEQ ID NO: 1143 - RNA, 22 nt, Homo Sapiens
ugagguaggugcugaaacugcu

SEQ ID NO: 1144 - RNA, 21 nt, Homo Sapiens
ugagguaggugcugaaacugc

SEQ ID NO: 1145 - RNA, 22 nt, Homo Sapiens
ugagggaggaaguuugggauga

SEQ ID NO: 1146 - RNA, 22 nt, Homo Sapiens
uaugucacuccuuugcccagac

SEQ ID NO: 1147 - RNA, 22 nt, Homo Sapiens
ucacccaggcuggagugcagug

SEQ ID NO: 1148 - RNA, 22 nt, Homo Sapiens
gucugcugucuacacuacacac

SEQ ID NO: 1149 - RNA, 22 nt, Homo Sapiens
guauguguggguuucucagccu

SEQ ID NO: 1150 - RNA, 22 nt, Homo Sapiens
guggccuuucuggucuguguau

SEQ ID NO: 1151 - RNA, 22 nt, Homo Sapiens
guguuuuuccaaaugacaucca

SEQ ID NO: 1152 - RNA, 22 nt, Homo Sapiens
gcccuguugaccagaauuuguu

SEQ ID NO: 1153 - RNA, 22 nt, Homo Sapiens
ggcccaggagggggagaaaggc

SEQ ID NO: 1154 - RNA, 22 nt, Homo Sapiens
uaagaagagaaagaagaggcug

SEQ ID NO: 1155 - RNA, 22 nt, Homo Sapiens
gugugugauaaggacacagaua

SEQ ID NO: 1156 - RNA, 22 nt, Homo Sapiens
gucacugcaaucaacaauacuc

SEQ ID NO: 1157 - RNA, 22 nt, Homo Sapiens
uagugcaguugaaugaacauuu

SEQ ID NO: 1158 - RNA, 22 nt, Homo Sapiens
uacagcucugcuucuggcucac

SEQ ID NO: 1159 - RNA, 22 nt, Homo Sapiens
ugaaagagaugggacagugacu

SEQ ID NO: 1160 - RNA, 22 nt, Homo Sapiens
ugcuuuaguucuucugaagugu

SEQ ID NO: 1161 - RNA, 22 nt, Homo Sapiens
uguguaaugcugagauuugggc

SEQ ID NO: 1162 - RNA, 22 nt, Homo Sapiens
uuagaaagaauauugccagucc

SEQ ID NO: 1163 - RNA, 22 nt, Homo Sapiens
aguaagcaaacucaguuuaauc

SEQ ID NO: 1164 - RNA, 22 nt, Homo Sapiens
agguggcacugugugggguggg

SEQ ID NO: 1165 - RNA, 22 nt, Homo Sapiens
aggcagguggguguaugggucu

SEQ ID NO: 1166 - RNA, 22 nt, Homo Sapiens
agagacacagacacaugggaga

SEQ ID NO: 1167 - RNA, 22 nt, Homo Sapiens
agcugccaguugaagaacauuu

SEQ ID NO: 1168 - RNA, 22 nt, Homo Sapiens
cuggagaggagcggucacuggu

SEQ ID NO: 1169 - RNA, 22 nt, Homo Sapiens
cuugcacuccacagccugggug

SEQ ID NO: 1170 - RNA, 22 nt, Homo Sapiens
gaggucacuguuggaugucaga

SEQ ID NO: 1171 - RNA, 22 nt, Homo Sapiens
auuuggggaaauguguuucugg

SEQ ID NO: 1172 - RNA, 22 nt, Homo Sapiens
cacugcaaugacugucagaaca

SEQ ID NO: 1173 - RNA, 22 nt, Homo Sapiens
uuccuucaguucagggaacccu

SEQ ID NO: 1174 - RNA, 22 nt, Homo Sapiens
uugagcacaguuugaggagugu

SEQ ID NO: 1175 - RNA, 22 nt, Homo Sapiens
uuucauucauuucuuucaugga

SEQ ID NO: 1176 - RNA, 22 nt, Homo Sapiens
cacccaggcuggagugcagugg

SEQ ID NO: 1177 - RNA, 22 nt, Homo Sapiens
cccaggcuggagugcaguggug

SEQ ID NO: 1178 - RNA, 22 nt, Homo Sapiens
cuacuuguuccucucaccucaa

SEQ ID NO: 1179 - RNA, 22 nt, Homo Sapiens
cuccuaggcuggagugcagugg

SEQ ID NO: 1180 - RNA, 22 nt, Homo Sapiens
aggcugagugcaguggugugau

SEQ ID NO: 1181 - RNA, 22 nt, Homo Sapiens
aggcugcaguguaguggcauga

SEQ ID NO: 1182 - RNA, 22 nt, Homo Sapiens
augaugcuggaacuggacaaca

SEQ ID NO: 1183 - RNA, 22 nt, Homo Sapiens
auuagcuauagcaaaaggcuua

SEQ ID NO: 1184 - RNA, 22 nt, Homo Sapiens
acugcacuccagucugggugac

SEQ ID NO: 1185 - RNA, 22 nt, Homo Sapiens
uuaaugcuaaucgugauagggg

SEQ ID NO: 1186 - RNA, 22 nt, Homo Sapiens
uucaggacugucuggauuuauu

SEQ ID NO: 1187 - RNA, 22 nt, Homo Sapiens
uggagcagaaaggcaggagucc

SEQ ID NO: 1188 - RNA, 22 nt, Homo Sapiens
ugagggcaggugugaaaaugcu

SEQ ID NO: 1189 - RNA, 22 nt, Homo Sapiens
ugcaagucugugauuuuguguu

SEQ ID NO: 1190 - RNA, 22 nt, Homo Sapiens
ugcagccuugaacucuuucugg

SEQ ID NO: 1191 - RNA, 22 nt, Homo Sapiens
ucacuguuccuuuuuguugaga

SEQ ID NO: 1192 - RNA, 22 nt, Homo Sapiens
ucauccuuuucugcaaccuguu

SEQ ID NO: 1193 - RNA, 22 nt, Homo Sapiens
gugcauuuguaguuaaaugugu

SEQ ID NO: 1194 - RNA, 22 nt, Homo Sapiens
guacaguggguguagggaccag

SEQ ID NO: 1195 - RNA, 22 nt, Homo Sapiens
guaaggcuggcauuagggugag

SEQ ID NO: 1196 - RNA, 22 nt, Homo Sapiens
gggcgugaugucagccagaguc

SEQ ID NO: 1197 - RNA, 22 nt, Homo Sapiens
guuacagcucucaaagaagaca

SEQ ID NO: 1198 - RNA, 22 nt, Homo Sapiens
uaaggacgcaaagagggcaagg

SEQ ID NO: 1199 - RNA, 22 nt, Homo Sapiens
ugacagagguacauaggaggcu

SEQ ID NO: 1200 - RNA, 22 nt, Homo Sapiens
agcaaaagccaugcccaggaga

SEQ ID NO: 1201 - RNA, 22 nt, Homo Sapiens
agcuccaggagcuggcaggagg

SEQ ID NO: 1202 - RNA, 22 nt, Homo Sapiens
aggccuuuuugggaagagacag

SEQ ID NO: 1203 - RNA, 22 nt, Homo Sapiens
agucagacguuuggcaacagca

SEQ ID NO: 1204 - RNA, 22 nt, Homo Sapiens
aaaggcagacggugaaugccuu

SEQ ID NO: 1205 - RNA, 22 nt, Homo Sapiens
aaucccagcuacucgggaggcu

SEQ ID NO: 1206 - RNA, 22 nt, Homo Sapiens
aagugcugggauuacaggccug

SEQ ID NO: 1207 - RNA, 22 nt, Homo Sapiens
cuggcucccucucuucucuccc

SEQ ID NO: 1208 - RNA, 22 nt, Homo Sapiens
gauggcagcuggagguggagca

SEQ ID NO: 1209 - RNA, 22 nt, Homo Sapiens
gaggagguggggcagcagcagg

SEQ ID NO: 1210 - RNA, 22 nt, Homo Sapiens
gacccuguguucaagguuaggg

SEQ ID NO: 1211 - RNA, 22 nt, Homo Sapiens
gagagagguagaggggagcaga

SEQ ID NO: 1212 - RNA, 22 nt, Homo Sapiens
cguguaaucccagcuacuuggg

SEQ ID NO: 1213 - RNA, 22 nt, Homo Sapiens
ccucuccauguacccauucccc

SEQ ID NO: 1214 - RNA, 22 nt, Homo Sapiens
ccaaagugcuggcguuacaggu

SEQ ID NO: 1215 - RNA, 22 nt, Homo Sapiens
ccaaagugcugggauuacaggc

SEQ ID NO: 1216 - RNA, 22 nt, Homo Sapiens
ccagccugagguuccuggaggg

SEQ ID NO: 1217 - RNA, 22 nt, Homo Sapiens
caaagugcugagauuacaggca

SEQ ID NO: 1218 - RNA, 22 nt, Homo Sapiens
auugcuugagcccaggaguuca

SEQ ID NO: 1219 - RNA, 22 nt, Homo Sapiens
ugcaugaugcugagguuuggga

SEQ ID NO: 1220 - RNA, 22 nt, Homo Sapiens
ugaggugaucagcaagguggag

SEQ ID NO: 1221 - RNA, 22 nt, Homo Sapiens
ucagucguuucucucucccagc

SEQ ID NO: 1222 - RNA, 22 nt, Homo Sapiens
uccccaagccuuguaccagcgu

SEQ ID NO: 1223 - RNA, 22 nt, Homo Sapiens
ucugagcccaggaguuugaggc

SEQ ID NO: 1224 - RNA, 22 nt, Homo Sapiens
ucugcuuggacugaucauugaa

SEQ ID NO: 1225 - RNA, 22 nt, Homo Sapiens
ucucaguuuccucugcaaacag

SEQ ID NO: 1226 - RNA, 22 nt, Homo Sapiens
uggcucaguuugcucagcagug

SEQ ID NO: 1227 - RNA, 22 nt, Homo Sapiens
ugguccagaggaggaaugaggg

SEQ ID NO: 1228 - RNA, 22 nt, Homo Sapiens
uucacauguugcucaguuuugc

SEQ ID NO: 1229 - RNA, 22 nt, Homo Sapiens
uucaguucuugaccugccccag

SEQ ID NO: 1230 - RNA, 22 nt, Homo Sapiens
uguguuggagcagaggcagggg

SEQ ID NO: 1231 - RNA, 22 nt, Homo Sapiens
ugucuggaggcgcaguuuucag

SEQ ID NO: 1232 - RNA, 22 nt, Homo Sapiens
uagcagcaggagcagguaacau

SEQ ID NO: 1233 - RNA, 22 nt, Homo Sapiens
uaucgcuugagcccaggaguuu

SEQ ID NO: 1234 - RNA, 22 nt, Homo Sapiens
gugugggcagggccgugcuccc

SEQ ID NO: 1235 - RNA, 22 nt, Homo Sapiens
gguccacaaggggagagcaggg

SEQ ID NO: 1236 - RNA, 22 nt, Homo Sapiens
ggccucagaagcugaggggaga

SEQ ID NO: 1237 - RNA, 22 nt, Homo Sapiens
ggcugggcaugguggcucacgc

SEQ ID NO: 1238 - RNA, 22 nt, Homo Sapiens
ggcuggagaguaaaucaggucu

SEQ ID NO: 1239 - RNA, 22 nt, Homo Sapiens
ggcccaggagggggagaaaggc

SEQ ID NO: 1240 - RNA, 22 nt, Homo Sapiens
ggcaugauucagcagaggagag

SEQ ID NO: 1241 - RNA, 21 nt, Homo Sapiens
gccuccauuucuacaucucua

SEQ ID NO: 1242 - RNA, 22 nt, Homo Sapiens
gccuguaaucccagcuacuugg

SEQ ID NO: 1243 - RNA, 22 nt, Homo Sapiens
gcccaggagucugaggcuggag

SEQ ID NO: 1244 - RNA, 22 nt, Homo Sapiens
gauugcuugagcccuggagguu

SEQ ID NO: 1245 - RNA, 22 nt, Homo Sapiens
gcagcaggcagggccaggcagg

SEQ ID NO: 1246 - RNA, 22 nt, Homo Sapiens
gcugcuccugcucucccucucc

SEQ ID NO: 1247 - RNA, 22 nt, Homo Sapiens
gccuuuccuccagaacugcucc

SEQ ID NO: 1248 - RNA, 22 nt, Homo Sapiens
uuuacagauggcaaagaucugg

SEQ ID NO: 1249 - RNA, 22 nt, Homo Sapiens
uuugaaguggguccucgaaaug

SEQ ID NO: 1250 - RNA, 22 nt, Homo Sapiens
uucccucauucuccacccaguc

SEQ ID NO: 1251 - RNA, 22 nt, Homo Sapiens
uuuggucuaaucuucaagagga

SEQ ID NO: 1252 - RNA, 22 nt, Homo Sapiens
uuuguaauagcaaaauacugga

SEQ ID NO: 1253 - RNA, 22 nt, Homo Sapiens
uugcaaggaaggggaggaggcu

SEQ ID NO: 1254 - RNA, 22 nt, Homo Sapiens
uuugaugcaugugaccugggau

SEQ ID NO: 1255 - RNA, 22 nt, Homo Sapiens
uuucauucauuucuuucaugga

SEQ ID NO: 1256 - RNA, 22 nt, Homo Sapiens
uugcuuugguucaaguuaggca

SEQ ID NO: 1257 - RNA, 22 nt, Homo Sapiens
gcuucuccuguccccucccuac

SEQ ID NO: 1258 - RNA, 22 nt, Homo Sapiens
ggaggaggaggcuggugcuggu

SEQ ID NO: 1259 - RNA, 22 nt, Homo Sapiens
gcaggcugguuggugaggcaaa

SEQ ID NO: 1260 - RNA, 22 nt, Homo Sapiens
ggcaugauggagaggguggaga

SEQ ID NO: 1261 - RNA, 22 nt, Homo Sapiens
ggaggaggugugaagaaaugaa

SEQ ID NO: 1262 - RNA, 22 nt, Homo Sapiens
ggcacugagaagcaaacaggau

SEQ ID NO: 1263 - RNA, 22 nt, Homo Sapiens
ggcuggagaguaaaucaggucu

SEQ ID NO: 1264 - RNA, 22 nt, Homo Sapiens
gggaggauccuugcucaacuua

SEQ ID NO: 1265 - RNA, 22 nt, Homo Sapiens
gguucaauucaccggagucuca

SEQ ID NO: 1266 - RNA, 22 nt, Homo Sapiens
guccagugcucacugccgacau

SEQ ID NO: 1267 - RNA, 22 nt, Homo Sapiens
uaagcagucuuucuucuucuuc

SEQ ID NO: 1268 - RNA, 22 nt, Homo Sapiens
uguuauuuuguccaagagagag

SEQ ID NO: 1269 - RNA, 22 nt, Homo Sapiens
uucaagaaagccaagauggcug

SEQ ID NO: 1270 - RNA, 22 nt, Homo Sapiens
uccuuaggaccuagagguagua

SEQ ID NO: 1271 - RNA, 22 nt, Homo Sapiens
ucuuugcuggaaggugccuccc

SEQ ID NO: 1272 - RNA, 22 nt, Homo Sapiens
ucccacagcuuccuagccacag

SEQ ID NO: 1273 - RNA, 22 nt, Homo Sapiens
cagagaauggcacagcuguccu

SEQ ID NO: 1274 - RNA, 22 nt, Homo Sapiens
caggugcaaguguuaaagggua

SEQ ID NO: 1275 - RNA, 22 nt, Homo Sapiens
ccuggagugacagguguagccu

SEQ ID NO: 1276 - RNA, 22 nt, Homo Sapiens
cuggcucccucucuucucuccc

SEQ ID NO: 1277 - RNA, 22 nt, Homo Sapiens
cucugagucugagagaguaggu

SEQ ID NO: 1278 - RNA, 22 nt, Homo Sapiens
aagugcugguauuacaagugug

SEQ ID NO: 1279 - RNA, 22 nt, Homo Sapiens
aggugggguuucaccauguugg

SEQ ID NO: 1280 - RNA, 22 nt, Homo Sapiens
aggcagguggguguaugggucu

SEQ ID NO: 1281 - RNA, 22 nt, Homo Sapiens
agcagcucaagucuucuccaga

SEQ ID NO: 1282 - RNA, 22 nt, Homo Sapiens
agagcuaggaagauacaggguu

SEQ ID NO: 1283 - RNA, 22 nt, Homo Sapiens
caugguacugccacagaagagu

SEQ ID NO: 1284 - RNA, 22 nt, Homo Sapiens
ugggcucauuuugcagugauuu

SEQ ID NO: 1285 - RNA, 22 nt, Homo Sapiens
uaauuuccugguagugaugaca

SEQ ID NO: 1286 - RNA, 22 nt, Homo Sapiens
uaggagugaaaauaaacucugu

SEQ ID NO: 1287 - RNA, 22 nt, Homo Sapiens
uaggaaguauuuuuuaaaaaca

SEQ ID NO: 1288 - RNA, 22 nt, Homo Sapiens
uaugaauguaaggaauguggga

SEQ ID NO: 1289 - RNA, 22 nt, Homo Sapiens
uagugcaagguuuugccaacuu

SEQ ID NO: 1290 - RNA, 22 nt, Homo Sapiens
gugcauuuguaguuaaaugugu

SEQ ID NO: 1291 - RNA, 22 nt, Homo Sapiens
gguucucaaaugagggacauuu

SEQ ID NO: 1292 - RNA, 22 nt, Homo Sapiens
uaagaagagaaagaagaggcug

SEQ ID NO: 1293 - RNA, 22 nt, Homo Sapiens
ggcagaugggacucugugccca

SEQ ID NO: 1294 - RNA, 22 nt, Homo Sapiens
ugcuagguuuuuuccuuucccc

SEQ ID NO: 1295 - RNA, 22 nt, Homo Sapiens
uucacauguugcucaguuuugc

SEQ ID NO: 1296 - RNA, 22 nt, Homo Sapiens
ucuuugaucucuuccggggcuu

SEQ ID NO: 1297 - RNA, 22 nt, Homo Sapiens
ugaguauucaccaggugcuggg

SEQ ID NO: 1298 - RNA, 22 nt, Homo Sapiens
ugagggggaaggugugugugug

SEQ ID NO: 1299 - RNA, 22 nt, Homo Sapiens
ugagguaaguauguuauuggaa

SEQ ID NO: 1300 - RNA, 22 nt, Homo Sapiens
cagugggaaaaguuugucucau

SEQ ID NO: 1301 - RNA, 22 nt, Homo Sapiens
gagguagagguugcagugaguc

SEQ ID NO: 1302 - RNA, 22 nt, Homo Sapiens
gagguagagguugcagugagug

SEQ ID NO: 1303 - RNA, 22 nt, Homo Sapiens
agaggcacagauuaauggaguu

SEQ ID NO: 1304 - RNA, 22 nt, Homo Sapiens
aggccagagaggacucucuuuu

SEQ ID NO: 1305 - RNA, 22 nt, Homo Sapiens
aguauuucuuguuuuauugaga

SEQ ID NO: 1306 - RNA, 22 nt, Homo Sapiens
augcccuuccucuucugccaug

SEQ ID NO: 1307 - RNA, 22 nt, Homo Sapiens
acaaggcagggcaggugucugu

SEQ ID NO: 1308 - RNA, 22 nt, Homo Sapiens
aaaggcagacggugaaugccuu

SEQ ID NO: 1309 - RNA, 22 nt, Homo Sapiens
aagacacuuucuaaauagaagu

SEQ ID NO: 1310 - RNA, 22 nt, Homo Sapiens
uugccuggagacauuucuacug

SEQ ID NO: 1311 - RNA, 22 nt, Homo Sapiens
uuuccuguuuugguuuggagag

SEQ ID NO: 1312 - RNA, 22 nt, Homo Sapiens
uuguaaauaacauuuuuuagca

SEQ ID NO: 1313 - RNA, 22 nt, Homo Sapiens
uugagcaaaauaucugguuuca

SEQ ID NO: 1314 - RNA, 22 nt, Homo Sapiens
uucuuuuuccgcuuucugagcc

SEQ ID NO: 1315 - RNA, 22 nt, Homo Sapiens
aggcugcaguguaguggcauga

SEQ ID NO: 1316 - RNA, 22 nt, Homo Sapiens
uuacugggcuccucucagugug

SEQ ID NO: 1317 - RNA, 22 nt, Homo Sapiens
uucacaguggcugaagcuguuc

SEQ ID NO: 1318 - RNA, 22 nt, Homo Sapiens
ugucuggaggcgcaguuuucag

SEQ ID NO: 1319 - RNA, 22 nt, Homo Sapiens
uguacaaggggcucagccagcc

SEQ ID NO: 1320 - RNA, 22 nt, Homo Sapiens
uggagaccugugugguuugugg

SEQ ID NO: 1321 - RNA, 22 nt, Homo Sapiens
uggaggcaggugcagauggagg

SEQ ID NO: 1322 - RNA, 22 nt, Homo Sapiens
uggagugucuggaggugucucu

SEQ ID NO: 1323 - RNA, 22 nt, Homo Sapiens
ugggaggcuacacguuucucca

SEQ ID NO: 1324 - RNA, 22 nt, Homo Sapiens
ucugcugugauggacacuugua

SEQ ID NO: 1325 - RNA, 21 nt, Homo Sapiens
ucugcugugauggacacuugu

SEQ ID NO: 1326 - RNA, 22 nt, Homo Sapiens
ucugccucccugucucacucuc

SEQ ID NO: 1327 - RNA, 22 nt, Homo Sapiens
ucccagucaucugggaugugca

SEQ ID NO: 1328 - RNA, 22 nt, Homo Sapiens
ucccucugccugcaguccugcu

SEQ ID NO: 1329 - RNA, 22 nt, Homo Sapiens
ggcaccaucucagcucacugga

SEQ ID NO: 1330 - RNA, 22 nt, Homo Sapiens
ggcaauauuccaggauaggcug

SEQ ID NO: 1331 - RNA, 22 nt, Homo Sapiens
ggaguaugagagagaaugggac

SEQ ID NO: 1332 - RNA, 22 nt, Homo Sapiens
ggcaugauggagaggguggaga

SEQ ID NO: 1333 - RNA, 22 nt, Homo Sapiens
ggcaugugugagcagcugcagg

SEQ ID NO: 1334 - RNA, 22 nt, Homo Sapiens
gcagcucccuauuccaugacag

SEQ ID NO: 1335 - RNA, 22 nt, Homo Sapiens
gcugaauuuugacuccaucucc

SEQ ID NO: 1336 - RNA, 22 nt, Homo Sapiens
ggaggaggaggcuggugcuggu

SEQ ID NO: 1337 - RNA, 22 nt, Homo Sapiens
ggacugcagucacacucuaaga

SEQ ID NO: 1338 - RNA, 22 nt, Homo Sapiens
gcugcuccugcucucccucucc

SEQ ID NO: 1339 - RNA, 22 nt, Homo Sapiens
guuuuaggcaacauaggaagac

SEQ ID NO: 1340 - RNA, 22 nt, Homo Sapiens
gugauuaaauuaaggcucuuga

SEQ ID NO: 1341 - RNA, 22 nt, Homo Sapiens
ggugacagagacucugccucga

SEQ ID NO: 1342 - RNA, 22 nt, Homo Sapiens
guaacaaaaugaauaauaccug

SEQ ID NO: 1343 - RNA, 22 nt, Homo Sapiens
guauguauuuauagauguucuu

SEQ ID NO: 1344 - RNA, 22 nt, Homo Sapiens
gucagcaaggagggguggacaa

SEQ ID NO: 1345 - RNA, 22 nt, Homo Sapiens
guauggagaucucugcccuugu

SEQ ID NO: 1346 - RNA, 22 nt, Homo Sapiens
gucuuccuccguccccaccucc

SEQ ID NO: 1347 - RNA, 22 nt, Homo Sapiens
uauugcacuccagccugggcaa

SEQ ID NO: 1348 - RNA, 22 nt, Homo Sapiens
uagggggucaccuaugugggag

SEQ ID NO: 1349 - RNA, 22 nt, Homo Sapiens
uaagcagucuuucuucuucuuc

SEQ ID NO: 1350 - RNA, 22 nt, Homo Sapiens
uaaguaaagagagaagccagaa

SEQ ID NO: 1351 - RNA, 22 nt, Homo Sapiens
aggggguuuagcuccacagggu

SEQ ID NO: 1352 - RNA, 22 nt, Homo Sapiens
aggcaguaagggagaguuuugc

SEQ ID NO: 1353 - RNA, 22 nt, Homo Sapiens
aggccuuuuugggaagagacag

SEQ ID NO: 1354 - RNA, 22 nt, Homo Sapiens
aggcagguggguguaugggucu

SEQ ID NO: 1355 - RNA, 22 nt, Homo Sapiens
agagcuaggaagauacaggguu

SEQ ID NO: 1356 - RNA, 22 nt, Homo Sapiens
agagacacagacacaugggaga

SEQ ID NO: 1357 - RNA, 22 nt, Homo Sapiens
agcagcucaagucuucuccaga

SEQ ID NO: 1358 - RNA, 22 nt, Homo Sapiens
agcagagccaccaaauuuagug

SEQ ID NO: 1359 - RNA, 22 nt, Homo Sapiens
agcaagaugguagcauuggaga

SEQ ID NO: 1360 - RNA, 22 nt, Homo Sapiens
auucccuuuagcucugauggca

SEQ ID NO: 1361 - RNA, 22 nt, Homo Sapiens
augggagacugaggggcggacg

SEQ ID NO: 1362 - RNA, 22 nt, Homo Sapiens
agguggcacugugugggguggg

SEQ ID NO: 1363 - RNA, 22 nt, Homo Sapiens
agucagacguuuggcaacagca

SEQ ID NO: 1364 - RNA, 22 nt, Homo Sapiens
aguccaguguucucugcucugu

SEQ ID NO: 1365 - RNA, 22 nt, Homo Sapiens
auaagcacagggagguucuguc

SEQ ID NO: 1366 - RNA, 22 nt, Homo Sapiens
aaauccuggggaucuggaggga

SEQ ID NO: 1367 - RNA, 22 nt, Homo Sapiens
aaagacaguucagugacaaguu

SEQ ID NO: 1368 - RNA, 22 nt, Homo Sapiens
aaagacuuggcugucagcccug

SEQ ID NO: 1369 - RNA, 22 nt, Homo Sapiens
aaggcuuuucugggaagagcug

SEQ ID NO: 1370 - RNA, 22 nt, Homo Sapiens
aaugaagccacagagauuugcu

SEQ ID NO: 1371 - RNA, 22 nt, Homo Sapiens
acugcacuccauccugagugac

SEQ ID NO: 1372 - RNA, 22 nt, Homo Sapiens
acugcacuccagccuggcaaca

SEQ ID NO: 1373 - RNA, 22 nt, Homo Sapiens
acccacccucugugaggaggau

SEQ ID NO: 1374 - RNA, 22 nt, Homo Sapiens
accagcugcauccugcaaacuu

SEQ ID NO: 1375 - RNA, 22 nt, Homo Sapiens
acuguacuccacccugggcgac

SEQ ID NO: 1376 - RNA, 22 nt, Homo Sapiens
gaggucacuguuggaugucaga

SEQ ID NO: 1377 - RNA, 22 nt, Homo Sapiens
gauggcagcuggagguggagca

SEQ ID NO: 1378 - RNA, 22 nt, Homo Sapiens
gaacagcuccagucuacagccc

SEQ ID NO: 1379 - RNA, 22 nt, Homo Sapiens
gaagcauugugagaaacagguu

SEQ ID NO: 1380 - RNA, 22 nt, Homo Sapiens
cuccuacaacugacucucugga

SEQ ID NO: 1381 - RNA, 22 nt, Homo Sapiens
cuggcucccucucuucucuccc

SEQ ID NO: 1382 - RNA, 22 nt, Homo Sapiens
cuggcucccaggaggccucucu

SEQ ID NO: 1383 - RNA, 22 nt, Homo Sapiens
cuggguggccuucaguccauga

SEQ ID NO: 1384 - RNA, 22 nt, Homo Sapiens
cuggugaggaaggagcagaguu

SEQ ID NO: 1385 - RNA, 22 nt, Homo Sapiens
cugugcccagccagggcugugu

SEQ ID NO: 1386 - RNA, 22 nt, Homo Sapiens
cagugggaaaaguuugucucau

SEQ ID NO: 1387 - RNA, 22 nt, Homo Sapiens
cagaggaugcggcugggaacgg

SEQ ID NO: 1388 - RNA, 22 nt, Homo Sapiens
caugguacugccacagaagagu

SEQ ID NO: 1389 - RNA, 22 nt, Homo Sapiens
caucucagucuauguccuugcu

SEQ ID NO: 1390 - RNA, 22 nt, Homo Sapiens
cauugcacuccagccuaggcaa

SEQ ID NO: 1391 - RNA, 22 nt, Homo Sapiens
cauugcacuccacccuaggcaa

SEQ ID NO: 1392 - RNA, 22 nt, Homo Sapiens
cauuggguaucaccuauacaga

SEQ ID NO: 1393 - RNA, 22 nt, Homo Sapiens
cgcuauguuggccaggcugguc

SEQ ID NO: 1394 - RNA, 22 nt, Homo Sapiens
uugagcaaaauaucugguuuca

SEQ ID NO: 1395 - RNA, 22 nt, Homo Sapiens
uugcaaggaaggggaggaggcu

SEQ ID NO: 1396 - RNA, 22 nt, Homo Sapiens
uugcauaugcauggguacacag

SEQ ID NO: 1397 - RNA, 22 nt, Homo Sapiens
uuucuggagggcaagugcaggg

SEQ ID NO: 1398 - RNA, 22 nt, Homo Sapiens
uuuggucuaaucuucaagagga

SEQ ID NO: 1399 - RNA, 22 nt, Homo Sapiens
uugcccaggcuggagugcagug

SEQ ID NO: 1400 - RNA, 22 nt, Homo Sapiens
uugcccaggcuagagugcagug

SEQ ID NO: 1401 - RNA, 22 nt, Homo Sapiens
cccaggcuggagugcaguggug

SEQ ID NO: 1402 - RNA, 22 nt, Homo Sapiens
ccaaagugcugggauuacaggc

SEQ ID NO: 1403 - RNA, 22 nt, Homo Sapiens
ccaaagugcuaggauuacagcc

SEQ ID NO: 1404 - RNA, 22 nt, Homo Sapiens
cccaggaggcggagguugcagu

SEQ ID NO: 1405 - RNA, 22 nt, Homo Sapiens
ccaaagugcuggcguuacaggu

SEQ ID NO: 1406 - RNA, 22 nt, Homo Sapiens
ccaaagugcuaggaauacaggu

SEQ ID NO: 1407 - RNA, 22 nt, Homo Sapiens
cagaaucuuuugucucugagaa

SEQ ID NO: 1408 - RNA, 22 nt, Homo Sapiens
cagguggugcuguuaagaagca

SEQ ID NO: 1409 - RNA, 22 nt, Homo Sapiens
caaagugcugagauuacaggca

SEQ ID NO: 1410 - RNA, 22 nt, Homo Sapiens
cacugcaaugacugucagaaca

SEQ ID NO: 1411 - RNA, 22 nt, Homo Sapiens
cugggauuacaggugugaacca

SEQ ID NO: 1412 - RNA, 22 nt, Homo Sapiens
cugauugaaccauucacuuuau

SEQ ID NO: 1413 - RNA, 22 nt, Homo Sapiens
gagauccuuucacaguuguggu

SEQ ID NO: 1414 - RNA, 22 nt, Homo Sapiens
gagugagugugaucuuggcuca

SEQ ID NO: 1415 - RNA, 22 nt, Homo Sapiens
agaaguaguaguagcaguagua

SEQ ID NO: 1416 - RNA, 22 nt, Homo Sapiens
acaguguuacccaggcuggucu

SEQ ID NO: 1417 - RNA, 22 nt, Homo Sapiens
aagugcugggauuacaggccug

SEQ ID NO: 1418 - RNA, 22 nt, Homo Sapiens
acagcaagucuuugucaaagcu

SEQ ID NO: 1419 - RNA, 22 nt, Homo Sapiens
agugauuuuccugccucagccu

SEQ ID NO: 1420 - RNA, 22 nt, Homo Sapiens
augugucugggacucuaugcca

SEQ ID NO: 1421 - RNA, 22 nt, Homo Sapiens
agacuggccucaagcucccaga

SEQ ID NO: 1422 - RNA, 22 nt, Homo Sapiens
aggcugagugcaguggugugau

SEQ ID NO: 1423 - RNA, 22 nt, Homo Sapiens
aggcuuuuggagaagcauaugc

SEQ ID NO: 1424 - RNA, 22 nt, Homo Sapiens
agggagugucagaaugccagca

SEQ ID NO: 1425 - RNA, 22 nt, Homo Sapiens
uagaaagcuaacaagcuagaga

SEQ ID NO: 1426 - RNA, 22 nt, Homo Sapiens
uagcaaccuuaauauuuuacag

SEQ ID NO: 1427 - RNA, 22 nt, Homo Sapiens
ucacugcaaccucugcuucugg

SEQ ID NO: 1428 - RNA, 22 nt, Homo Sapiens
gugcucaucuucuguaacuguu

SEQ ID NO: 1429 - RNA, 22 nt, Homo Sapiens
gauuuucauaggagcagaaacc

SEQ ID NO: 1430 - RNA, 22 nt, Homo Sapiens
ggcaaggaagaaagcagaaguu

SEQ ID NO: 1431 - RNA, 22 nt, Homo Sapiens
ggcaggaucauagcucacugca

SEQ ID NO: 1432 - RNA, 22 nt, Homo Sapiens
ggcgugaucuuggcucaccaca

SEQ ID NO: 1433 - RNA, 22 nt, Homo Sapiens
ucaguagcugucaaaacuggag

SEQ ID NO: 1434 - RNA, 22 nt, Homo Sapiens
ucucauauagcuggguugcagc

SEQ ID NO: 1435 - RNA, 22 nt, Homo Sapiens
ugaaaugcuuuuaggacacugc

SEQ ID NO: 1436 - RNA, 22 nt, Homo Sapiens
ugauccucuggcuucagccucc

SEQ ID NO: 1437 - RNA, 22 nt, Homo Sapiens
ugcagccuugaacucuuucugg

SEQ ID NO: 1438 - RNA, 22 nt, Homo Sapiens
ugcaagucugugauuuuguguu

SEQ ID NO: 1439 - RNA, 22 nt, Homo Sapiens
ucuaacacugacuucuauucca

SEQ ID NO: 1440 - RNA, 21 nt, Homo Sapiens
ucugcugugauggacacuugu

SEQ ID NO: 1441 - RNA, 22 nt, Homo Sapiens
ucugcugugauggacacuugua

SEQ ID NO: 1442 - RNA, 22 nt, Homo Sapiens
ucugccucccugucucacucuc

SEQ ID NO: 1443 - RNA, 22 nt, Homo Sapiens
uggagcagaaaggcaggagucc

SEQ ID NO: 1444 - RNA, 22 nt, Homo Sapiens
uguguuggagcagaggcagggg

SEQ ID NO: 1445 - RNA, 22 nt, Homo Sapiens
uuauccuaaauguguuuugaag

SEQ ID NO: 1446 - RNA, 22 nt, Homo Sapiens
uucagcauugccaguguuucca

SEQ ID NO: 1447 - RNA, 22 nt, Homo Sapiens
uuccaguuuuuccuaccccuua

SEQ ID NO: 1448 - RNA, 22 nt, Homo Sapiens
gggcaugaugauggcacuagcg

SEQ ID NO: 1449 - RNA, 22 nt, Homo Sapiens
ggcaauauuccaggauaggcug

SEQ ID NO: 1450 - RNA, 22 nt, Homo Sapiens
ggcaugauggagaggguggaga

SEQ ID NO: 1451 - RNA, 22 nt, Homo Sapiens
gcagcaggcagggccaggcagg

SEQ ID NO: 1452 - RNA, 22 nt, Homo Sapiens
gaguuaagcaaagagaggaaga

SEQ ID NO: 1453 - RNA, 22 nt, Homo Sapiens
gcacauucccgcaggguguaag

SEQ ID NO: 1454 - RNA, 22 nt, Homo Sapiens
ggaauggauggaagugugugag

SEQ ID NO: 1455 - RNA, 22 nt, Homo Sapiens
guuaggaaaugugcuuacuggg

SEQ ID NO: 1456 - RNA, 22 nt, Homo Sapiens
ucacugcaaccucugcuucugg

SEQ ID NO: 1457 - RNA, 22 nt, Homo Sapiens
ucaaguaauccaggauaggcug

SEQ ID NO: 1458 - RNA, 22 nt, Homo Sapiens
uaguuguuugggauugguagug

SEQ ID NO: 1459 - RNA, 22 nt, Homo Sapiens
uagaaagugucucauuuuaaua

SEQ ID NO: 1460 - RNA, 22 nt, Homo Sapiens
uaagcagucuuucuucuucuuc

SEQ ID NO: 1461 - RNA, 22 nt, Homo Sapiens
aggcaagagguugcagugagcu

SEQ ID NO: 1462 - RNA, 22 nt, Homo Sapiens
agcagcgcagguagauggggcu

SEQ ID NO: 1463 - RNA, 22 nt, Homo Sapiens
auaagcacagggagguucuguc

SEQ ID NO: 1464 - RNA, 22 nt, Homo Sapiens
acacuugucugcuuucuacacu

SEQ ID NO: 1465 - RNA, 22 nt, Homo Sapiens
aagcagaacuguuuuguuuucu

SEQ ID NO: 1466 - RNA, 22 nt, Homo Sapiens
gagguagagguugcagugaguc

SEQ ID NO: 1467 - RNA, 22 nt, Homo Sapiens
gagauccuuucacaguuguggu

SEQ ID NO: 1468 - RNA, 22 nt, Homo Sapiens
gacaagaggcacagacagcagg

SEQ ID NO: 1469 - RNA, 22 nt, Homo Sapiens
gaaacuaguguugggacaaagg

SEQ ID NO: 1470 - RNA, 22 nt, Homo Sapiens
cugcacuagaaggcacuauguu

SEQ ID NO: 1471 - RNA, 22 nt, Homo Sapiens
cuggcuaauuuucuugaguuuu

SEQ ID NO: 1472 - RNA, 22 nt, Homo Sapiens
cugugagcuauuuguuuugguu

SEQ ID NO: 1473 - RNA, 22 nt, Homo Sapiens
cuguucagaucugugugcauuu

SEQ ID NO: 1474 - RNA, 22 nt, Homo Sapiens
cacugcaaccucugccuccugg

SEQ ID NO: 1475 - RNA, 22 nt, Homo Sapiens
caaagugcugagauuacaggca

SEQ ID NO: 1476 - RNA, 22 nt, Homo Sapiens
cacuuucagagaugcccugagu

SEQ ID NO: 1477 - RNA, 22 nt, Homo Sapiens
uugcuucauuagggcaagcaag

SEQ ID NO: 1478 - RNA, 22 nt, Homo Sapiens
uugcccaggcuagagugcagug

SEQ ID NO: 1479 - RNA, 22 nt, Homo Sapiens
uugccuaggcuggagugcagug

SEQ ID NO: 1480 - RNA, 22 nt, Homo Sapiens
uugcccaggcuggagugcagug

SEQ ID NO: 1481 - RNA, 22 nt, Homo Sapiens
uugccuaggccggagugcagug

SEQ ID NO: 1482 - RNA, 22 nt, Homo Sapiens
uugcucaggcuggagugcagug

SEQ ID NO: 1483 - RNA, 22 nt, Homo Sapiens
uuuugcaaauuacuaaauuucu

SEQ ID NO: 1484 - RNA, 22 nt, Homo Sapiens
cacugcuguaauggacggugag

SEQ ID NO: 1485 - RNA, 22 nt, Homo Sapiens
cacugcacuguagccuccuggg

SEQ ID NO: 1486 - RNA, 22 nt, Homo Sapiens
caaagugcugagauuacaggca

SEQ ID NO: 1487 - RNA, 22 nt, Homo Sapiens
cacccaggcuggagugcagugg

SEQ ID NO: 1488 - RNA, 22 nt, Homo Sapiens
auuguaaauuaacaauuugcuc

SEQ ID NO: 1489 - RNA, 22 nt, Homo Sapiens
cacugcaaccucugccuccugg

SEQ ID NO: 1490 - RNA, 22 nt, Homo Sapiens
cacugcaaccuccaccuccugg

SEQ ID NO: 1491 - RNA, 22 nt, Homo Sapiens
cacugcaaccucugccaccugg

SEQ ID NO: 1492 - RNA, 22 nt, Homo Sapiens
cacugcaacccccgccucccag

SEQ ID NO: 1493 - RNA, 22 nt, Homo Sapiens
cacugcaagcuccaccucccgg

SEQ ID NO: 1494 - RNA, 22 nt, Homo Sapiens
ccaaagugcuaggaauacaggu

SEQ ID NO: 1495 - RNA, 22 nt, Homo Sapiens
ccaaagugcuggcguuacaggu

SEQ ID NO: 1496 - RNA, 22 nt, Homo Sapiens
ccaaagugcuaggauuacagcc

SEQ ID NO: 1497 - RNA, 22 nt, Homo Sapiens
ccaaagugcugggauuacaggc

SEQ ID NO: 1498 - RNA, 22 nt, Homo Sapiens
cccaggcuggagugcaguggug

SEQ ID NO: 1499 - RNA, 22 nt, Homo Sapiens
cgcuauguuggccaggcugguc

SEQ ID NO: 1500 - RNA, 22 nt, Homo Sapiens
ccuggagugacagguguagccu

SEQ ID NO: 1501 - RNA, 22 nt, Homo Sapiens
cugggauuacaggugugaacca

SEQ ID NO: 1502 - RNA, 22 nt, Homo Sapiens
cugccuccuggguucaagcaau

SEQ ID NO: 1503 - RNA, 22 nt, Homo Sapiens
cuccuaggcuggagugcagugg

SEQ ID NO: 1504 - RNA, 22 nt, Homo Sapiens
cucacugcaaccuccgccuccc

SEQ ID NO: 1505 - RNA, 22 nt, Homo Sapiens
gagguuugagccuucuccugcu

SEQ ID NO: 1506 - RNA, 22 nt, Homo Sapiens
acaaccucugccuccuggguuc

SEQ ID NO: 1507 - RNA, 22 nt, Homo Sapiens
aagugcugggauuacaggccug

SEQ ID NO: 1508 - RNA, 22 nt, Homo Sapiens
acaguguuacccaggcuggucu

SEQ ID NO: 1509 - RNA, 22 nt, Homo Sapiens
acugcagcuucagggacuugug

SEQ ID NO: 1510 - RNA, 22 nt, Homo Sapiens
aguuccauggaaaacaacaaag

SEQ ID NO: 1511 - RNA, 22 nt, Homo Sapiens
agugauuuuccugccucagccu

SEQ ID NO: 1512 - RNA, 22 nt, Homo Sapiens
aggugggguuucaccauguugg

SEQ ID NO: 1513 - RNA, 22 nt, Homo Sapiens
aggcugagugcaguggugugau

SEQ ID NO: 1514 - RNA, 22 nt, Homo Sapiens
uagaguuauaugaugugcuagu

SEQ ID NO: 1515 - RNA, 22 nt, Homo Sapiens
ucacccaggcuggagugcagug

SEQ ID NO: 1516 - RNA, 22 nt, Homo Sapiens
ucaagcgauucucaugccuuag

SEQ ID NO: 1517 - RNA, 22 nt, Homo Sapiens
ucacugcaaccucugcuucugg

SEQ ID NO: 1518 - RNA, 22 nt, Homo Sapiens
ucacugcaaccuccgccugccg

SEQ ID NO: 1519 - RNA, 22 nt, Homo Sapiens
ucacugcaaccuccaccucccg

SEQ ID NO: 1520 - RNA, 22 nt, Homo Sapiens
ucacugcaaccucugccuuccg

SEQ ID NO: 1521 - RNA, 22 nt, Homo Sapiens
gucuugaucuccugaccuugug

SEQ ID NO: 1522 - RNA, 22 nt, Homo Sapiens
gcugugguucugcaugaagaca

SEQ ID NO: 1523 - RNA, 22 nt, Homo Sapiens
ugugacugaggugcgcauaaag

SEQ ID NO: 1524 - RNA, 22 nt, Homo Sapiens
uuaccauguuggccaggcuggu

SEQ ID NO: 1525 - RNA, 22 nt, Homo Sapiens
ugugccacugcacuccaugggu

SEQ ID NO: 1526 - RNA, 22 nt, Homo Sapiens
uggacaaugaaacccugaccuu

SEQ ID NO: 1527 - RNA, 22 nt, Homo Sapiens
ugggguuucuccauguugguca

SEQ ID NO: 1528 - RNA, 22 nt, Homo Sapiens
ucauugcaaccuccaccuccug

SEQ ID NO: 1529 - RNA, 21 nt, Homo Sapiens
ugagguaggugcugaaacugc

SEQ ID NO: 1530 - RNA, 22 nt, Homo Sapiens
ugagguaggugcugaaacugcu

SEQ ID NO: 1531 - RNA, 22 nt, Homo Sapiens
aaaguggcuggaguggagucuu

SEQ ID NO: 1532 - RNA, 22 nt, Homo Sapiens
cuggcuaauuuucuugaguuuu

SEQ ID NO: 1533 - RNA, 22 nt, Homo Sapiens
ccaggguacucugggaucacuu

SEQ ID NO: 1534 - RNA, 22 nt, Homo Sapiens
cccaggagguggagguuacagu

SEQ ID NO: 1535 - RNA, 22 nt, Homo Sapiens
cguguaaucccagcuacuuggg

SEQ ID NO: 1536 - RNA, 22 nt, Homo Sapiens
cuauuuuacauggucacuauca

SEQ ID NO: 1537 - RNA, 22 nt, Homo Sapiens
cauuucaacuuuguuguucuuu

SEQ ID NO: 1538 - RNA, 22 nt, Homo Sapiens
ccacugcacuccagcacuccag

SEQ ID NO: 1539 - RNA, 22 nt, Homo Sapiens
ccacugcacuccagccugggug

SEQ ID NO: 1540 - RNA, 22 nt, Homo Sapiens
cccaggaggcggagguugcagu

SEQ ID NO: 1541 - RNA, 22 nt, Homo Sapiens
ccaggcaacuguguuuuuuaag

SEQ ID NO: 1542 - RNA, 22 nt, Homo Sapiens
cauugcacuccagccuggguga

SEQ ID NO: 1543 - RNA, 22 nt, Homo Sapiens
cauugcacuccacccuaggcaa

SEQ ID NO: 1544 - RNA, 22 nt, Homo Sapiens
cauugcacuccagccuaggcaa

SEQ ID NO: 1545 - RNA, 22 nt, Homo Sapiens
caugguacugccacagaagagu

SEQ ID NO: 1546 - RNA, 22 nt, Homo Sapiens
cacugcacucagccugggugac

SEQ ID NO: 1547 - RNA, 22 nt, Homo Sapiens
cacugcacuccagcccggcaac

SEQ ID NO: 1548 - RNA, 22 nt, Homo Sapiens
cacugcacuccacccugggcaa

SEQ ID NO: 1549 - RNA, 22 nt, Homo Sapiens
auugcuugagcccaggaguuca

SEQ ID NO: 1550 - RNA, 22 nt, Homo Sapiens
auuguucuccagccugggcgac

SEQ ID NO: 1551 - RNA, 22 nt, Homo Sapiens
cacacagucguguaguuuugcg

SEQ ID NO: 1552 - RNA, 22 nt, Homo Sapiens
cacugcacuguagccuccuggg

SEQ ID NO: 1553 - RNA, 22 nt, Homo Sapiens
cacugcacucuagccucgguga

SEQ ID NO: 1554 - RNA, 22 nt, Homo Sapiens
cacccccaggaccaccuugcga

SEQ ID NO: 1555 - RNA, 22 nt, Homo Sapiens
cacugcacuccaaccuggacaa

SEQ ID NO: 1556 - RNA, 22 nt, Homo Sapiens
cacugcacuccagccuaggcaa

SEQ ID NO: 1557 - RNA, 22 nt, Homo Sapiens
cacugcacuccagccugggcga

SEQ ID NO: 1558 - RNA, 22 nt, Homo Sapiens
cacugcacuccagccuggguaa

SEQ ID NO: 1559 - RNA, 22 nt, Homo Sapiens
cacugcacuccagccuggguga

SEQ ID NO: 1560 - RNA, 22 nt, Homo Sapiens
cagaaucuuuugucucugagaa

SEQ ID NO: 1561 - RNA, 22 nt, Homo Sapiens
cagagagguucaaugucuuacu

SEQ ID NO: 1562 - RNA, 22 nt, Homo Sapiens
cuggcuaauuuucuugaguuuu

SEQ ID NO: 1563 - RNA, 22 nt, Homo Sapiens
cuggaagacaugguagagcuga

SEQ ID NO: 1564 - RNA, 21 nt, Homo Sapiens
cugcuaaacauccuacacugc

SEQ ID NO: 1565 - RNA, 22 nt, Homo Sapiens
cugaggucaggaguucgagacc

SEQ ID NO: 1566 - RNA, 22 nt, Homo Sapiens
cugaggcaggagggcucaggag

SEQ ID NO: 1567 - RNA, 22 nt, Homo Sapiens
cucagauacuugggagguugag

SEQ ID NO: 1568 - RNA, 22 nt, Homo Sapiens
cuccuacaacugacucucugga

SEQ ID NO: 1569 - RNA, 22 nt, Homo Sapiens
cugggauggaggagaauuagag

SEQ ID NO: 1570 - RNA, 22 nt, Homo Sapiens
cugugggugagagagugggaga

SEQ ID NO: 1571 - RNA, 22 nt, Homo Sapiens
cuugcacuccacagccugggug

SEQ ID NO: 1572 - RNA, 22 nt, Homo Sapiens
gaggcgggaagcccacuaggag

SEQ ID NO: 1573 - RNA, 22 nt, Homo Sapiens
gagguagagguugcagugagug

SEQ ID NO: 1574 - RNA, 22 nt, Homo Sapiens
gaguaacagcacucacuggagu

SEQ ID NO: 1575 - RNA, 22 nt, Homo Sapiens
gauuccuccucuuuaaaauggu

SEQ ID NO: 1576 - RNA, 22 nt, Homo Sapiens
gagguagagguugcagugaguc

SEQ ID NO: 1577 - RNA, 22 nt, Homo Sapiens
gagauggaguuuuacuauguug

SEQ ID NO: 1578 - RNA, 22 nt, Homo Sapiens
gagcagguuuggaauggcucca

SEQ ID NO: 1579 - RNA, 22 nt, Homo Sapiens
gaauaaugucccacugggaggc

SEQ ID NO: 1580 - RNA, 22 nt, Homo Sapiens
aacccuggaggcagagguugcg

SEQ ID NO: 1581 - RNA, 22 nt, Homo Sapiens
aagcugccauugaagaucuggg

SEQ ID NO: 1582 - RNA, 22 nt, Homo Sapiens
aaucccagcuacucgggaggcu

SEQ ID NO: 1583 - RNA, 22 nt, Homo Sapiens
acaaaaaauuagccagacuggu

SEQ ID NO: 1584 - RNA, 22 nt, Homo Sapiens
acaaaaaauacgaaaauuagcu

SEQ ID NO: 1585 - RNA, 22 nt, Homo Sapiens
acagcaguccagccugggugac

SEQ ID NO: 1586 - RNA, 22 nt, Homo Sapiens
acugcacucuagccugagcaac

SEQ ID NO: 1587 - RNA, 22 nt, Homo Sapiens
acugcacucuagccugggcaac

SEQ ID NO: 1588 - RNA, 22 nt, Homo Sapiens
acugcacuucagccugggcaau

SEQ ID NO: 1589 - RNA, 22 nt, Homo Sapiens
acugcacucuagccuaggugau

SEQ ID NO: 1590 - RNA, 22 nt, Homo Sapiens
acugcacuccugccugggugac

SEQ ID NO: 1591 - RNA, 22 nt, Homo Sapiens
acugcacuccugccuaggugac

SEQ ID NO: 1592 - RNA, 22 nt, Homo Sapiens
acugcacuccauccuggggagc

SEQ ID NO: 1593 - RNA, 22 nt, Homo Sapiens
acuguacuucagccuggguaac

SEQ ID NO: 1594 - RNA, 22 nt, Homo Sapiens
acugggauaugaagacugugug

SEQ ID NO: 1595 - RNA, 22 nt, Homo Sapiens
acuguacuccagccugggcaac

SEQ ID NO: 1596 - RNA, 22 nt, Homo Sapiens
acuguacuccagccugggugac

SEQ ID NO: 1597 - RNA, 22 nt, Homo Sapiens
acuguacuccagccuaggcaac

SEQ ID NO: 1598 - RNA, 22 nt, Homo Sapiens
acuguacuucagccugggcaac

SEQ ID NO: 1599 - RNA, 22 nt, Homo Sapiens
acugcacuccagccuggcaaca

SEQ ID NO: 1600 - RNA, 22 nt, Homo Sapiens
acugcacuccagccuaugggau

SEQ ID NO: 1601 - RNA, 22 nt, Homo Sapiens
acugcacuccaaccaggcugac

SEQ ID NO: 1602 - RNA, 22 nt, Homo Sapiens
accugcauuccagccugcugac

SEQ ID NO: 1603 - RNA, 22 nt, Homo Sapiens
acccgagagguggagguugcag

SEQ ID NO: 1604 - RNA, 22 nt, Homo Sapiens
acugcacuccauccugagugac

SEQ ID NO: 1605 - RNA, 22 nt, Homo Sapiens
acugcacuccauccugggacag

SEQ ID NO: 1606 - RNA, 22 nt, Homo Sapiens
acugcacuccagucugggugac

SEQ ID NO: 1607 - RNA, 22 nt, Homo Sapiens
acugcacuccagucuaggugac

SEQ ID NO: 1608 - RNA, 22 nt, Homo Sapiens
acugcacuccagccuguugaca

SEQ ID NO: 1609 - RNA, 22 nt, Homo Sapiens
acugcacuccagccuggcgaca

SEQ ID NO: 1610 - RNA, 22 nt, Homo Sapiens
acugcacuccagccugggcgau

SEQ ID NO: 1611 - RNA, 22 nt, Homo Sapiens
acugcacuccagccugggugau

SEQ ID NO: 1612 - RNA, 22 nt, Homo Sapiens
acugcacuccagccugggugac

SEQ ID NO: 1613 - RNA, 22 nt, Homo Sapiens
acugcacuccagccuggguggc

SEQ ID NO: 1614 - RNA, 22 nt, Homo Sapiens
agggcacacgucucucugaauu

SEQ ID NO: 1615 - RNA, 22 nt, Homo Sapiens
aggguuguuaguuuuuugguug

SEQ ID NO: 1616 - RNA, 22 nt, Homo Sapiens
aggugagaaaacugaggcucag

SEQ ID NO: 1617 - RNA, 22 nt, Homo Sapiens
aggcaagagguugcagugagcu

SEQ ID NO: 1618 - RNA, 22 nt, Homo Sapiens
agcggagaccugagcuaugagu

SEQ ID NO: 1619 - RNA, 22 nt, Homo Sapiens
agagacacagacacaugggaga

SEQ ID NO: 1620 - RNA, 22 nt, Homo Sapiens
agaggcacagauuaauggaguu

SEQ ID NO: 1621 - RNA, 22 nt, Homo Sapiens
agcaaaagccaugcccaggaga

SEQ ID NO: 1622 - RNA, 22 nt, Homo Sapiens
agauggaguuugagagggaaua

SEQ ID NO: 1623 - RNA, 22 nt, Homo Sapiens
agaugauguuggagucugugcu

SEQ ID NO: 1624 - RNA, 22 nt, Homo Sapiens
agauggagaaguguuuucagau

SEQ ID NO: 1625 - RNA, 22 nt, Homo Sapiens
agugagcuaugaucaugccggu

SEQ ID NO: 1626 - RNA, 22 nt, Homo Sapiens
agugagccgagauacauacaua

SEQ ID NO: 1627 - RNA, 22 nt, Homo Sapiens
agugguuucagggacuucugua

SEQ ID NO: 1628 - RNA, 22 nt, Homo Sapiens
auacagcucucucuggggacuu

SEQ ID NO: 1629 - RNA, 22 nt, Homo Sapiens
auacugagagaaaaagcuuguc

SEQ ID NO: 1630 - RNA, 22 nt, Homo Sapiens
auagaagagcagugggguagaa

SEQ ID NO: 1631 - RNA, 22 nt, Homo Sapiens
auauuggugaaaugcuagcaaa

SEQ ID NO: 1632 - RNA, 22 nt, Homo Sapiens
auugcacuccagccugggcaau

SEQ ID NO: 1633 - RNA, 22 nt, Homo Sapiens
auugcacuccagccugggugac

SEQ ID NO: 1634 - RNA, 22 nt, Homo Sapiens
auugcacuccagcuugggcaac

SEQ ID NO: 1635 - RNA, 22 nt, Homo Sapiens
auugcacuucagccugggugac

SEQ ID NO: 1636 - RNA, 22 nt, Homo Sapiens
augccuguaaucccagcauuuu

SEQ ID NO: 1637 - RNA, 22 nt, Homo Sapiens
augccuguaaucccagcacuuu

SEQ ID NO: 1638 - RNA, 22 nt, Homo Sapiens
auggcucauguuuguagucuca

SEQ ID NO: 1639 - RNA, 22 nt, Homo Sapiens
augagaguaggaguuugggcuc

SEQ ID NO: 1640 - RNA, 22 nt, Homo Sapiens
aucuuucuuaauuccaggacuc

SEQ ID NO: 1641 - RNA, 22 nt, Homo Sapiens
augacacaguggggccaguugg

SEQ ID NO: 1642 - RNA, 22 nt, Homo Sapiens
ugagguaggugcugaaacugcu

SEQ ID NO: 1643 - RNA, 22 nt, Homo Sapiens
ugaggucauguucugucagguu

SEQ ID NO: 1644 - RNA, 21 nt, Homo Sapiens
ugagguaggugcugaaacugc

SEQ ID NO: 1645 - RNA, 22 nt, Homo Sapiens
ugagguaggaugauugcuagcu

SEQ ID NO: 1646 - RNA, 22 nt, Homo Sapiens
ugagggcaggugugaaaaugcu

SEQ ID NO: 1647 - RNA, 22 nt, Homo Sapiens
ugaggcagaaggauuacuugag

SEQ ID NO: 1648 - RNA, 22 nt, Homo Sapiens
ugagauggugucauauugcugg

SEQ ID NO: 1649 - RNA, 22 nt, Homo Sapiens
ugacucaguggaagauccagag

SEQ ID NO: 1650 - RNA, 22 nt, Homo Sapiens
ugcaagucugugauuuuguguu

SEQ ID NO: 1651 - RNA, 22 nt, Homo Sapiens
ugaggugaucagcaagguggag

SEQ ID NO: 1652 - RNA, 22 nt, Homo Sapiens
ugagguuaguaguuugagacca

SEQ ID NO: 1653 - RNA, 22 nt, Homo Sapiens
ugcaccacugcacuccagccug

SEQ ID NO: 1654 - RNA, 22 nt, Homo Sapiens
ugcaccaaugcacuccagccug

SEQ ID NO: 1655 - RNA, 22 nt, Homo Sapiens
ugcaccacugcacucuaaccug

SEQ ID NO: 1656 - RNA, 22 nt, Homo Sapiens
uccaaaaguggagaggaauaug

SEQ ID NO: 1657 - RNA, 22 nt, Homo Sapiens
uccaaaauuaaagguuguagaa

SEQ ID NO: 1658 - RNA, 22 nt, Homo Sapiens
ucagugcaaacuaagcagggca

SEQ ID NO: 1659 - RNA, 22 nt, Homo Sapiens
ucauaucauuuugaaagcugag

SEQ ID NO: 1660 - RNA, 22 nt, Homo Sapiens
ucacuguuccuuuuuguugaga

SEQ ID NO: 1661 - RNA, 22 nt, Homo Sapiens
ucacuugccuagggucacacag

SEQ ID NO: 1662 - RNA, 22 nt, Homo Sapiens
ucagaguaggcuugauguaauc

SEQ ID NO: 1663 - RNA, 22 nt, Homo Sapiens
ucgaguugaugcuagaaugggu

SEQ ID NO: 1664 - RNA, 22 nt, Homo Sapiens
uccauugcacuccagucugggc

SEQ ID NO: 1665 - RNA, 22 nt, Homo Sapiens
ucugagcccaggaguuugaggc

SEQ ID NO: 1666 - RNA, 22 nt, Homo Sapiens
ucugcugugauggacacuugua

SEQ ID NO: 1667 - RNA, 21 nt, Homo Sapiens
ucugcugugauggacacuugu

SEQ ID NO: 1668 - RNA, 22 nt, Homo Sapiens
ucuuucuuaaauggaugcauga

SEQ ID NO: 1669 - RNA, 22 nt, Homo Sapiens
ugggaagaugcuggcaaggugc

SEQ ID NO: 1670 - RNA, 22 nt, Homo Sapiens
uggcagauuugguugcuguugg

SEQ ID NO: 1671 - RNA, 22 nt, Homo Sapiens
uggagagaaagcgaagauguag

SEQ ID NO: 1672 - RNA, 22 nt, Homo Sapiens
uggaaagcauguacauuuggag

SEQ ID NO: 1673 - RNA, 22 nt, Homo Sapiens
ugcuacauuucuucauucuugg

SEQ ID NO: 1674 - RNA, 22 nt, Homo Sapiens
uggagagagcagguugcuaaga

SEQ ID NO: 1675 - RNA, 22 nt, Homo Sapiens
ugugccacugcacuccaugggu

SEQ ID NO: 1676 - RNA, 22 nt, Homo Sapiens
uguguuggagcagaggcagggg

SEQ ID NO: 1677 - RNA, 22 nt, Homo Sapiens
ugucauauagaauguucuauga

SEQ ID NO: 1678 - RNA, 22 nt, Homo Sapiens
ugugacucguacuuguaauccu

SEQ ID NO: 1679 - RNA, 22 nt, Homo Sapiens
uuaccauguuggccaggcuggu

SEQ ID NO: 1680 - RNA, 22 nt, Homo Sapiens
uguuauuuuguccaagagagag

SEQ ID NO: 1681 - RNA, 22 nt, Homo Sapiens
uuccaagccuuccccgggauca

SEQ ID NO: 1682 - RNA, 22 nt, Homo Sapiens
gcuggguugagcugggcugaga

SEQ ID NO: 1683 - RNA, 22 nt, Homo Sapiens
ggaaaguuaaagauguauguau

SEQ ID NO: 1684 - RNA, 22 nt, Homo Sapiens
ggacugagacaugauuaacuug

SEQ ID NO: 1685 - RNA, 22 nt, Homo Sapiens
ggagcuguaguuuuucccacau

SEQ ID NO: 1686 - RNA, 22 nt, Homo Sapiens
ggaagaaugugcuuuuguuguu

SEQ ID NO: 1687 - RNA, 22 nt, Homo Sapiens
ggaggcagugguugcagugagc

SEQ ID NO: 1688 - RNA, 22 nt, Homo Sapiens
gccuguaaucccagcuacuugg

SEQ ID NO: 1689 - RNA, 22 nt, Homo Sapiens
gcccaggagucugaggcuggag

SEQ ID NO: 1690 - RNA, 22 nt, Homo Sapiens
gccauugcacuccagccugggc

SEQ ID NO: 1691 - RNA, 22 nt, Homo Sapiens
gccauugcacuccagccuggac

SEQ ID NO: 1692 - RNA, 22 nt, Homo Sapiens
gcaggugugcaaaucacaacuu

SEQ ID NO: 1693 - RNA, 22 nt, Homo Sapiens
gauugcuugagcccuggagguu

SEQ ID NO: 1694 - RNA, 22 nt, Homo Sapiens
gcaagugcugucauauggaaga

SEQ ID NO: 1695 - RNA, 22 nt, Homo Sapiens
gcacucaagccuggguuacaga

SEQ ID NO: 1696 - RNA, 22 nt, Homo Sapiens
ggcaugauggagaggguggaga

SEQ ID NO: 1697 - RNA, 22 nt, Homo Sapiens
ggcaugauucagcagaggagag

SEQ ID NO: 1698 - RNA, 22 nt, Homo Sapiens
ggcccaggagggggagaaaggc

SEQ ID NO: 1699 - RNA, 22 nt, Homo Sapiens
ggcaaaaaaauagagcagaggg

SEQ ID NO: 1700 - RNA, 22 nt, Homo Sapiens
gguagcuuauuaaagaaacucc

SEQ ID NO: 1701 - RNA, 22 nt, Homo Sapiens
ggcugcagugcaacucuuucua

SEQ ID NO: 1702 - RNA, 22 nt, Homo Sapiens
ggcugcagugaacuaugaucgu

SEQ ID NO: 1703 - RNA, 22 nt, Homo Sapiens
ggcugggcaugguggcucacgc

SEQ ID NO: 1704 - RNA, 22 nt, Homo Sapiens
guacuccagccugccuggguaa

SEQ ID NO: 1705 - RNA, 22 nt, Homo Sapiens
gguucaauucaccggagucuca

SEQ ID NO: 1706 - RNA, 22 nt, Homo Sapiens
guguuauuaauaaacucuuuuu

SEQ ID NO: 1707 - RNA, 22 nt, Homo Sapiens
gugucacuuucaggagcucuaa

SEQ ID NO: 1708 - RNA, 22 nt, Homo Sapiens
guggcaccauuggagucuaagg

SEQ ID NO: 1709 - RNA, 22 nt, Homo Sapiens
ucacuguaaacucaaacuccug

SEQ ID NO: 1710 - RNA, 22 nt, Homo Sapiens
uaugaauguaaggaauguggga

SEQ ID NO: 1711 - RNA, 22 nt, Homo Sapiens
uaucgcuugagcccaggaguuu

SEQ ID NO: 1712 - RNA, 22 nt, Homo Sapiens
uauugcacuccagccugggcaa

SEQ ID NO: 1713 - RNA, 22 nt, Homo Sapiens
uauugcuaagaauucagguagu

SEQ ID NO: 1714 - RNA, 22 nt, Homo Sapiens
uaugagugugaugguguuugag

SEQ ID NO: 1715 - RNA, 22 nt, Homo Sapiens
uagcagaucugugacuccuaug

SEQ ID NO: 1716 - RNA, 22 nt, Homo Sapiens
uagcucauuuuugaaaucaguu

SEQ ID NO: 1717 - RNA, 21 nt, Homo Sapiens
uaagugaguaggcauuguucu

SEQ ID NO: 1718 - RNA, 22 nt, Homo Sapiens
uuugcacacuuuccaaguugcc

SEQ ID NO: 1719 - RNA, 22 nt, Homo Sapiens
uugguugcugaugagcuuugag

SEQ ID NO: 1720 - RNA, 22 nt, Homo Sapiens
uugccuaggcuggagugcagug

SEQ ID NO: 1721 - RNA, 22 nt, Homo Sapiens
uugguuggugaugagcauugaa

SEQ ID NO: 1722 - RNA, 22 nt, Homo Sapiens
uuuacagauggcaaagaucugg

SEQ ID NO: 1723 - RNA, 22 nt, Homo Sapiens
uuguuuuagaagaaggucagaa

SEQ ID NO: 1724 - RNA, 22 nt, Homo Sapiens
uugcaaggaaggggaggaggcu

SEQ ID NO: 1725 - RNA, 22 nt, Homo Sapiens
uugcacuccagccuggguaaca

SEQ ID NO: 1726 - RNA, 22 nt, Homo Sapiens
uugaugaaugggugcuccagga

SEQ ID NO: 1727 - RNA, 22 nt, Homo Sapiens
uugcacuccagccugggugaca

SEQ ID NO: 1728 - RNA, 22 nt, Homo Sapiens
uugcacuccagucugggugaca

SEQ ID NO: 1729 - RNA, 22 nt, Homo Sapiens
uucugccacugcauuccagccu

SEQ ID NO: 1730 - RNA, 22 nt, Homo Sapiens
uucuggugaauucaggauggua

SEQ ID NO: 1731 - RNA, 22 nt, Homo Sapiens
uugaugaaugggugcuccagga

SEQ ID NO: 1732 - RNA, 22 nt, Homo Sapiens
uugaggucaucuaaugguguug

SEQ ID NO: 1733 - RNA, 22 nt, Homo Sapiens
uugagcacaguuugaggagugu

SEQ ID NO: 1734 - RNA, 22 nt, Homo Sapiens
uugcuuugguucaaguuaggca

SEQ ID NO: 1735 - RNA, 21 nt, Homo Sapiens
uacaagugcuccaguacggcc

SEQ ID NO: 1736 - RNA, 22 nt, Homo Sapiens
uaggaaguauuuuuuaaaaaca

SEQ ID NO: 1737 - RNA, 22 nt, Homo Sapiens
uauuacauucauuuugaugguu

SEQ ID NO: 1738 - RNA, 22 nt, Homo Sapiens
gucuugaucuccugaccuugug

SEQ ID NO: 1739 - RNA, 22 nt, Homo Sapiens
gugcuuccauuuccccaucugu

SEQ ID NO: 1740 - RNA, 22 nt, Homo Sapiens
gggcgugaugucagccagaguc

SEQ ID NO: 1741 - RNA, 22 nt, Homo Sapiens
ggcccaggagggggagaaaggc

SEQ ID NO: 1742 - RNA, 22 nt, Homo Sapiens
ggaagaaugugcuuuuguuguu

SEQ ID NO: 1743 - RNA, 22 nt, Homo Sapiens
uuagggcaggcaugagagaacu

SEQ ID NO: 1744 - RNA, 22 nt, Homo Sapiens
uguguacuugucuuaguuugcu

SEQ ID NO: 1745 - RNA, 22 nt, Homo Sapiens
uggagaaauuauauuuuacuaa

SEQ ID NO: 1746 - RNA, 22 nt, Homo Sapiens
uggcucaguuugcucagcagug

SEQ ID NO: 1747 - RNA, 22 nt, Homo Sapiens
ucuuuuuguuguagcuguaugg

SEQ ID NO: 1748 - RNA, 22 nt, Homo Sapiens
ucauaucauuuugaaagcugag

SEQ ID NO: 1749 - RNA, 22 nt, Homo Sapiens
ugaggugaucagcaagguggag

SEQ ID NO: 1750 - RNA, 22 nt, Homo Sapiens
ugagagaggaaggccguaggga

SEQ ID NO: 1751 - RNA, 22 nt, Homo Sapiens
ugaggaaggugugagaaaugag

SEQ ID NO: 1752 - RNA, 22 nt, Homo Sapiens
ugagggggaaggugugugugug

SEQ ID NO: 1753 - RNA, 22 nt, Homo Sapiens
augguguaggugaagagaacau

SEQ ID NO: 1754 - RNA, 22 nt, Homo Sapiens
agagugugucuauggaaggggu

SEQ ID NO: 1755 - RNA, 22 nt, Homo Sapiens
aggaauauaauuaaaacuuugc

SEQ ID NO: 1756 - RNA, 22 nt, Homo Sapiens
aggccagagaggacucucuuuu

SEQ ID NO: 1757 - RNA, 22 nt, Homo Sapiens
aggugagaaaacugaggcucag

SEQ ID NO: 1758 - RNA, 22 nt, Homo Sapiens
aagcagccuuggaccaggaggg

SEQ ID NO: 1759 - RNA, 22 nt, Homo Sapiens
ccagaggugagucuugauuuug

SEQ ID NO: 1760 - RNA, 22 nt, Homo Sapiens
cuggcucuaauaaccugagcuu

SEQ ID NO: 1761 - RNA, 22 nt, Homo Sapiens
cugaauagaacagaagagcagc

SEQ ID NO: 1762 - RNA, 22 nt, Homo Sapiens
aggugagaaaacugaggcucag

SEQ ID NO: 1763 - RNA, 22 nt, Homo Sapiens
ugaggacaggagguugugaguu

SEQ ID NO: 1764 - RNA, 22 nt, Homo Sapiens
ugaggucauguucugucagguu

SEQ ID NO: 1765 - RNA, 22 nt, Homo Sapiens
ugaguguaugugugagagagaa

SEQ ID NO: 1766 - RNA, 22 nt, Homo Sapiens
uggucucuugaaagaggcucuu

SEQ ID NO: 1767 - RNA, 22 nt, Homo Sapiens
uggagagagcagguugcuaaga

SEQ ID NO: 1768 - RNA, 22 nt, Homo Sapiens
uuccaguucucagcacagcgcu

SEQ ID NO: 1769 - RNA, 22 nt, Homo Sapiens
gcagcuguuuauuuagaaccug

SEQ ID NO: 1770 - RNA, 22 nt, Homo Sapiens
ggccaggacucuugcagaacug

SEQ ID NO: 1771 - RNA, 22 nt, Homo Sapiens
guggcauuggugguggcauugg

SEQ ID NO: 1772 - RNA, 22 nt, Homo Sapiens
uagagcaccuguugugugugca

SEQ ID NO: 1773 - RNA, 22 nt, Homo Sapiens
uaaggagcacacaaccuagauu

SEQ ID NO: 1774 - RNA, 22 nt, Homo Sapiens
guaaagaaaucauaaaagucca

SEQ ID NO: 1775 - RNA, 22 nt, Homo Sapiens
gcagcaggcagggccaggcagg

SEQ ID NO: 1776 - RNA, 22 nt, Homo Sapiens
gcccaggagucugaggcuggag

SEQ ID NO: 1777 - RNA, 22 nt, Homo Sapiens
gcuucuccuguccccucccuac

SEQ ID NO: 1778 - RNA, 22 nt, Homo Sapiens
ugguuaguuuuaugggccugga

SEQ ID NO: 1779 - RNA, 22 nt, Homo Sapiens
ugguggggagaggcuugggaag

SEQ ID NO: 1780 - RNA, 22 nt, Homo Sapiens
ugcaccacuacacuccuaggca

SEQ ID NO: 1781 - RNA, 22 nt, Homo Sapiens
ucauccuuuucugcaaccuguu

SEQ ID NO: 1782 - RNA, 22 nt, Homo Sapiens
ucccucugccugcaguccugcu

SEQ ID NO: 1783 - RNA, 22 nt, Homo Sapiens
ucugguuuuaauccugaaggca

SEQ ID NO: 1784 - RNA, 22 nt, Homo Sapiens
ucugccucccugucucacucuc

SEQ ID NO: 1785 - RNA, 22 nt, Homo Sapiens
aucucauaggcccccagugggg

SEQ ID NO: 1786 - RNA, 22 nt, Homo Sapiens
auaagcacagggagguucuguc

SEQ ID NO: 1787 - RNA, 22 nt, Homo Sapiens
acucagagccauuccgcucagg

SEQ ID NO: 1788 - RNA, 22 nt, Homo Sapiens
cugaauguaaucuuaguuguaa

SEQ ID NO: 1789 - RNA, 22 nt, Homo Sapiens
cuggcucccucucuucucuccc

SEQ ID NO: 1790 - RNA, 22 nt, Homo Sapiens
cuuuuugggguuuggggcuugg

SEQ ID NO: 1791 - RNA, 22 nt, Homo Sapiens
cuuuuccugggucugggcugug

SEQ ID NO: 1792 - RNA, 22 nt, Homo Sapiens
cagagcugccuuucccuuccug

SEQ ID NO: 1793 - RNA, 22 nt, Homo Sapiens
uucucccugcccacacauccag

SEQ ID NO: 1794 - RNA, 22 nt, Homo Sapiens
uuuucugggcucccuuuucugc

SEQ ID NO: 1795 - RNA, 22 nt, Homo Sapiens
gagcuaaggauagaggugagga

SEQ ID NO: 1796 - RNA, 22 nt, Homo Sapiens
gagguagagguugcagugaguc

SEQ ID NO: 1797 - RNA, 22 nt, Homo Sapiens
gaggugaagaucuuggagucug

SEQ ID NO: 1798 - RNA, 22 nt, Homo Sapiens
acccacccucugugaggaggau

SEQ ID NO: 1799 - RNA, 22 nt, Homo Sapiens
acuggcacagacaucugucaag

SEQ ID NO: 1800 - RNA, 22 nt, Homo Sapiens
aagcugccauugaagaucuggg

SEQ ID NO: 1801 - RNA, 22 nt, Homo Sapiens
aaugcugugccagagcugcacc

SEQ ID NO: 1802 - RNA, 22 nt, Homo Sapiens
aacccuggaggcagagguugcg

SEQ ID NO: 1803 - RNA, 22 nt, Homo Sapiens
aacgaugggcuggauuguuuug

SEQ ID NO: 1804 - RNA, 22 nt, Homo Sapiens
aagagcugaguaauugggggca

SEQ ID NO: 1805 - RNA, 22 nt, Homo Sapiens
aguaagcaaacucaguuuaauc

SEQ ID NO: 1806 - RNA, 22 nt, Homo Sapiens
agcuacauugucugcuggguuu

SEQ ID NO: 1807 - RNA, 22 nt, Homo Sapiens
agagcuaggaagauacaggguu

SEQ ID NO: 1808 - RNA, 22 nt, Homo Sapiens
agagacacagacacaugggaga

SEQ ID NO: 1809 - RNA, 22 nt, Homo Sapiens
ucucacacucugauuucuugcu

SEQ ID NO: 1810 - RNA, 22 nt, Homo Sapiens
ucauaaacuggcaagcacuacc

SEQ ID NO: 1811 - RNA, 22 nt, Homo Sapiens
ucagugcaaacuaagcagggca

SEQ ID NO: 1812 - RNA, 22 nt, Homo Sapiens
ugauuggcaaugguuaugacgg

SEQ ID NO: 1813 - RNA, 22 nt, Homo Sapiens
ugaggacaggagguugugaguu

SEQ ID NO: 1814 - RNA, 22 nt, Homo Sapiens
ugagggcaggugugaaaaugcu

SEQ ID NO: 1815 - RNA, 22 nt, Homo Sapiens
uggggcacuguggaggugucau

SEQ ID NO: 1816 - RNA, 22 nt, Homo Sapiens
uggcuguuugggguugccgugu

SEQ ID NO: 1817 - RNA, 22 nt, Homo Sapiens
uggcagauuugguugcuguugg

SEQ ID NO: 1818 - RNA, 22 nt, Homo Sapiens
uggagagagcagguugcuaaga

SEQ ID NO: 1819 - RNA, 22 nt, Homo Sapiens
ggaaaguuaaagauguauguau

SEQ ID NO: 1820 - RNA, 22 nt, Homo Sapiens
gccaggaugaagaggaggagaa

SEQ ID NO: 1821 - RNA, 22 nt, Homo Sapiens
ggugaugcauuuaaaagggcag

SEQ ID NO: 1822 - RNA, 22 nt, Homo Sapiens
ggcaugugugagcagcugcagg

SEQ ID NO: 1823 - RNA, 22 nt, Homo Sapiens
gguggguuuccuuaauggcauc

SEQ ID NO: 1824 - RNA, 22 nt, Homo Sapiens
guccugagaacugcuccaguua

SEQ ID NO: 1825 - RNA, 22 nt, Homo Sapiens
guuuggcacugaaucauauaca

SEQ ID NO: 1826 - RNA, 22 nt, Homo Sapiens
guugggugugagggggguccca

SEQ ID NO: 1827 - RNA, 22 nt, Homo Sapiens
guguguggaaaugcagaugacc

SEQ ID NO: 1828 - RNA, 22 nt, Homo Sapiens
guggcauuggugguggcauugg

SEQ ID NO: 1829 - RNA, 22 nt, Homo Sapiens
gugaggcaggaaccccaaagcc

SEQ ID NO: 1830 - RNA, 22 nt, Homo Sapiens
guggcaagugaccagaugucac

SEQ ID NO: 1831 - RNA, 22 nt, Homo Sapiens
guauggagaucucugcccuugu

SEQ ID NO: 1832 - RNA, 22 nt, Homo Sapiens
gugcuuccauuuccccaucugu

SEQ ID NO: 1833 - RNA, 22 nt, Homo Sapiens
guacuccagccugccuggguaa

SEQ ID NO: 1834 - RNA, 22 nt, Homo Sapiens
uacaaauguuucuucuccuuuu

SEQ ID NO: 1835 - RNA, 22 nt, Homo Sapiens
uaccccgauagggagggugggg

SEQ ID NO: 1836 - RNA, 22 nt, Homo Sapiens
ggcaugauggagaggguggaga

SEQ ID NO: 1837 - RNA, 22 nt, Homo Sapiens
ggcaaggaagaaagcagaaguu

SEQ ID NO: 1838 - RNA, 22 nt, Homo Sapiens
ggaguguaaagaaggauguuac

SEQ ID NO: 1839 - RNA, 22 nt, Homo Sapiens
ggcacugagaagcaaacaggau

SEQ ID NO: 1840 - RNA, 22 nt, Homo Sapiens
gguccacaaggggagagcaggg

SEQ ID NO: 1841 - RNA, 22 nt, Homo Sapiens
ggcgugaucuuggcucaccaca

SEQ ID NO: 1842 - RNA, 22 nt, Homo Sapiens
gcugagaaaaccagguuaaugg

SEQ ID NO: 1843 - RNA, 22 nt, Homo Sapiens
gcagcaggcagggccaggcagg

SEQ ID NO: 1844 - RNA, 22 nt, Homo Sapiens
gcagcgcugagaugauuuguug

SEQ ID NO: 1845 - RNA, 22 nt, Homo Sapiens
gcugcuccugcucucccucucc

SEQ ID NO: 1846 - RNA, 22 nt, Homo Sapiens
ggaggaggaggcuggugcuggu

SEQ ID NO: 1847 - RNA, 22 nt, Homo Sapiens
uggagagagcagguugcuaaga

SEQ ID NO: 1848 - RNA, 22 nt, Homo Sapiens
ugcucuugcucuuucuucugga

SEQ ID NO: 1849 - RNA, 22 nt, Homo Sapiens
uggcagauuugguugcuguugg

SEQ ID NO: 1850 - RNA, 22 nt, Homo Sapiens
uggcaaggugugggcuagagau

SEQ ID NO: 1851 - RNA, 22 nt, Homo Sapiens
ugggaggcuacacguuucucca

SEQ ID NO: 1852 - RNA, 22 nt, Homo Sapiens
ugguggggagaggcuugggaag

SEQ ID NO: 1853 - RNA, 22 nt, Homo Sapiens
uguaggugguugagagaaugaa

SEQ ID NO: 1854 - RNA, 22 nt, Homo Sapiens
ugugagagaaauggcaaguugg

SEQ ID NO: 1855 - RNA, 22 nt, Homo Sapiens
ugcaccaaugcacuccagccug

SEQ ID NO: 1856 - RNA, 22 nt, Homo Sapiens
ucaguugauagcagaugcuguu

SEQ ID NO: 1857 - RNA, 22 nt, Homo Sapiens
ucccucugccugcaguccugcu

SEQ ID NO: 1858 - RNA, 22 nt, Homo Sapiens
ucugcuuggacugaucauugaa

SEQ ID NO: 1859 - RNA, 22 nt, Homo Sapiens
ucugccucccugucucacucuc

SEQ ID NO: 1860 - RNA, 22 nt, Homo Sapiens
ucuugggauagugucucauggc

SEQ ID NO: 1861 - RNA, 22 nt, Homo Sapiens
agagcuaggaagauacaggguu

SEQ ID NO: 1862 - RNA, 22 nt, Homo Sapiens
aggccagagaggacucucuuuu

SEQ ID NO: 1863 - RNA, 22 nt, Homo Sapiens
auaccagcacaguggaugggga

SEQ ID NO: 1864 - RNA, 22 nt, Homo Sapiens
aguggcccuggcccuggggcau

SEQ ID NO: 1865 - RNA, 22 nt, Homo Sapiens
augacacaguggggccaguugg

SEQ ID NO: 1866 - RNA, 22 nt, Homo Sapiens
augagaguaggaguuugggcuc

SEQ ID NO: 1867 - RNA, 22 nt, Homo Sapiens
auucccuuuagcucugauggca

SEQ ID NO: 1868 - RNA, 22 nt, Homo Sapiens
aagagcugaguaauugggggca

SEQ ID NO: 1869 - RNA, 22 nt, Homo Sapiens
aagagguaguguaaggaauugu

SEQ ID NO: 1870 - RNA, 22 nt, Homo Sapiens
acacaggcccagagaggcagug

SEQ ID NO: 1871 - RNA, 22 nt, Homo Sapiens
agaaggcucgcucucucagggg

SEQ ID NO: 1872 - RNA, 22 nt, Homo Sapiens
accugcauuccagccugcugac

SEQ ID NO: 1873 - RNA, 22 nt, Homo Sapiens
gauggcagcuggagguggagca

SEQ ID NO: 1874 - RNA, 22 nt, Homo Sapiens
gagguagagguugcagugaguc

SEQ ID NO: 1875 - RNA, 22 nt, Homo Sapiens
cuuccuggguucauauccuggu

SEQ ID NO: 1876 - RNA, 22 nt, Homo Sapiens
gacaagaggcacagacagcagg

SEQ ID NO: 1877 - RNA, 22 nt, Homo Sapiens
gaccagccauccugguuuacau

SEQ ID NO: 1878 - RNA, 21 nt, Homo Sapiens
gacacaggcccagagaggcag

SEQ ID NO: 1879 - RNA, 22 nt, Homo Sapiens
cugugccugugacgagggauga

SEQ ID NO: 1880 - RNA, 22 nt, Homo Sapiens
cucugagucugagagaguaggu

SEQ ID NO: 1881 - RNA, 22 nt, Homo Sapiens
caguggaugauguuuucugugg

SEQ ID NO: 1882 - RNA, 22 nt, Homo Sapiens
cacuuucagagaugcccugagu

SEQ ID NO: 1883 - RNA, 22 nt, Homo Sapiens
cgacucuugaccauggcugggg

SEQ ID NO: 1884 - RNA, 22 nt, Homo Sapiens
ccccaccccaguggagcucacc

SEQ ID NO: 1885 - RNA, 22 nt, Homo Sapiens
ccugcccauccugccuccacca

SEQ ID NO: 1886 - RNA, 22 nt, Homo Sapiens
uugccuaggcuggagugcagug

SEQ ID NO: 1887 - RNA, 22 nt, Homo Sapiens
uugugcuuguacugaccaugua

SEQ ID NO: 1888 - RNA, 22 nt, Homo Sapiens
uuuguaauagcaaaauacugga

SEQ ID NO: 1889 - RNA, 22 nt, Homo Sapiens
cagugggaaaaguuugucucau

SEQ ID NO: 1890 - RNA, 22 nt, Homo Sapiens
cagagcaguggagaguaggucu

SEQ ID NO: 1891 - RNA, 22 nt, Homo Sapiens
cucagugguucagacacuguuu

SEQ ID NO: 1892 - RNA, 22 nt, Homo Sapiens
cugggcgugugaggcggcugug

SEQ ID NO: 1893 - RNA, 22 nt, Homo Sapiens
gacaugauguagcagaugaugg

SEQ ID NO: 1894 - RNA, 22 nt, Homo Sapiens
gaccagccauccugguuuacau

SEQ ID NO: 1895 - RNA, 22 nt, Homo Sapiens
gaaacuaguguugggacaaagg

SEQ ID NO: 1896 - RNA, 22 nt, Homo Sapiens
accagcugugugaacuuaggaa

SEQ ID NO: 1897 - RNA, 22 nt, Homo Sapiens
aacccuggaggcagagguugcg

SEQ ID NO: 1898 - RNA, 22 nt, Homo Sapiens
aaauccuggggaucuggaggga

SEQ ID NO: 1899 - RNA, 22 nt, Homo Sapiens
augucagugaagaggucuggca

SEQ ID NO: 1900 - RNA, 22 nt, Homo Sapiens
aucuuucuuaauuccaggacuc

SEQ ID NO: 1901 - RNA, 22 nt, Homo Sapiens
aguggcuuugaaacuguaauga

SEQ ID NO: 1902 - RNA, 22 nt, Homo Sapiens
auauuguguauucaggauagca

SEQ ID NO: 1903 - RNA, 22 nt, Homo Sapiens
aggccuuuuugggaagagacag

SEQ ID NO: 1904 - RNA, 22 nt, Homo Sapiens
aggcugagugacugggaguuag

SEQ ID NO: 1905 - RNA, 22 nt, Homo Sapiens
aggugagaaaacugaggcucag

SEQ ID NO: 1906 - RNA, 22 nt, Homo Sapiens
agggaguuuacauguuuucuaa

SEQ ID NO: 1907 - RNA, 22 nt, Homo Sapiens
agaagaucccugcucugaguca

SEQ ID NO: 1908 - RNA, 22 nt, Homo Sapiens
agcaagaugguagcauuggaga

SEQ ID NO: 1909 - RNA, 22 nt, Homo Sapiens
agcuccaggagcuggcaggagg

SEQ ID NO: 1910 - RNA, 22 nt, Homo Sapiens
ucuuuuuugggagacggagucg

SEQ ID NO: 1911 - RNA, 22 nt, Homo Sapiens
uccaaaauuaaagguuguagaa

SEQ ID NO: 1912 - RNA, 22 nt, Homo Sapiens
ugauuguaugauauaugaguuu

SEQ ID NO: 1913 - RNA, 22 nt, Homo Sapiens
ugauggaggaaauggugguauc

SEQ ID NO: 1914 - RNA, 22 nt, Homo Sapiens
ugaucacaggcaaaggaauaaa

SEQ ID NO: 1915 - RNA, 22 nt, Homo Sapiens
ugaggacaggagguugugaguu

SEQ ID NO: 1916 - RNA, 22 nt, Homo Sapiens
ugaggucauguucugucagguu

SEQ ID NO: 1917 - RNA, 22 nt, Homo Sapiens
ugacagagguacauaggaggcu

SEQ ID NO: 1918 - RNA, 22 nt, Homo Sapiens
ugugagagaaauggcaaguugg

SEQ ID NO: 1919 - RNA, 22 nt, Homo Sapiens
ugugucuguggaacagaagcag

SEQ ID NO: 1920 - RNA, 22 nt, Homo Sapiens
uguaggugguugagagaaugaa

SEQ ID NO: 1921 - RNA, 22 nt, Homo Sapiens
ugugaaggaggaagggaggagc

SEQ ID NO: 1922 - RNA, 22 nt, Homo Sapiens
ugggaaacauccagcacauacu

SEQ ID NO: 1923 - RNA, 22 nt, Homo Sapiens
uggcacauaguaaguguucagu

SEQ ID NO: 1924 - RNA, 22 nt, Homo Sapiens
ugggcacauacugcaucauuua

SEQ ID NO: 1925 - RNA, 22 nt, Homo Sapiens
ugcucuugcucuuucuucugga

SEQ ID NO: 1926 - RNA, 22 nt, Homo Sapiens
ugcuguaguauguauauaguau

SEQ ID NO: 1927 - RNA, 22 nt, Homo Sapiens
ugcacuugucuuuacccuagag

SEQ ID NO: 1928 - RNA, 22 nt, Homo Sapiens
ggaggaggaggcuggugcuggu

SEQ ID NO: 1929 - RNA, 22 nt, Homo Sapiens
ggaagaaugugcuuuuguuguu

SEQ ID NO: 1930 - RNA, 22 nt, Homo Sapiens
gcugcuccugcucucccucucc

SEQ ID NO: 1931 - RNA, 22 nt, Homo Sapiens
gcugugguucugcaugaagaca

SEQ ID NO: 1932 - RNA, 22 nt, Homo Sapiens
gcagcuguuuauuuagaaccug

SEQ ID NO: 1933 - RNA, 22 nt, Homo Sapiens
gauaucaugggaagguguacuu

SEQ ID NO: 1934 - RNA, 22 nt, Homo Sapiens
ggcugcagugaacuaugaucgu

SEQ ID NO: 1935 - RNA, 22 nt, Homo Sapiens
ggaggaggugugaagaaaugaa

SEQ ID NO: 1936 - RNA, 22 nt, Homo Sapiens
ggcaugauggagaggguggaga

SEQ ID NO: 1937 - RNA, 22 nt, Homo Sapiens
uagcagcaggagcagguaacau

SEQ ID NO: 1938 - RNA, 22 nt, Homo Sapiens
uagcugccaggcaacaaguacg

SEQ ID NO: 1939 - RNA, 22 nt, Homo Sapiens
uagaaagcuaacaagcuagaga

SEQ ID NO: 1940 - RNA, 22 nt, Homo Sapiens
uacucauuuaugcauuguuuug

SEQ ID NO: 1941 - RNA, 22 nt, Homo Sapiens
uaugugagacacuguccuaggc

SEQ ID NO: 1942 - RNA, 22 nt, Homo Sapiens
uauaugucugguauucuugggg

SEQ ID NO: 1943 - RNA, 22 nt, Homo Sapiens
uaugaauguaaggaauguggga

SEQ ID NO: 1944 - RNA, 22 nt, Homo Sapiens
uagugcaagguuuugccaacuu

SEQ ID NO: 1945 - RNA, 22 nt, Homo Sapiens
guauguauuuauagauguucuu

SEQ ID NO: 1946 - RNA, 22 nt, Homo Sapiens
guaacaaaaugaauaauaccug

SEQ ID NO: 1947 - RNA, 22 nt, Homo Sapiens
guacaguggguguagggaccag

SEQ ID NO: 1948 - RNA, 22 nt, Homo Sapiens
gugagaauggaggaagaacagu

SEQ ID NO: 1949 - RNA, 22 nt, Homo Sapiens
gugggcugagaaaggcugccca

SEQ ID NO: 1950 - RNA, 22 nt, Homo Sapiens
guucuucugggagaaaaauggc

SEQ ID NO: 1951 - RNA, 22 nt, Homo Sapiens
gugugugauaaggacacagaua

SEQ ID NO: 1952 - RNA, 22 nt, Homo Sapiens
gucuuccuccguccccaccucc

SEQ ID NO: 1953 - RNA, 22 nt, Homo Sapiens
uaggcagucucaguuguugggu

SEQ ID NO: 1954 - RNA, 22 nt, Homo Sapiens
gcucccuugucuagggcgugga

SEQ ID NO: 1955 - RNA, 22 nt, Homo Sapiens
ggcaccaucucagcucacugga

SEQ ID NO: 1956 - RNA, 22 nt, Homo Sapiens
gggccaugacagggagauaggc

SEQ ID NO: 1957 - RNA, 22 nt, Homo Sapiens
gcugcugccucaacauuuuagg

SEQ ID NO: 1958 - RNA, 22 nt, Homo Sapiens
uggagaauuaaaaaggguagug

SEQ ID NO: 1959 - RNA, 22 nt, Homo Sapiens
uggagcagaaaggcaggagucc

SEQ ID NO: 1960 - RNA, 22 nt, Homo Sapiens
uggcucugucuauugggaugug

SEQ ID NO: 1961 - RNA, 22 nt, Homo Sapiens
ugucaguuuuuuaaauacucag

SEQ ID NO: 1962 - RNA, 22 nt, Homo Sapiens
ucagguuccugauuggaguucu

SEQ ID NO: 1963 - RNA, 22 nt, Homo Sapiens
aggcaguguuguuccugauugc

SEQ ID NO: 1964 - RNA, 22 nt, Homo Sapiens
agguccucacacacagcucugc

SEQ ID NO: 1965 - RNA, 22 nt, Homo Sapiens
agguagggaggguagaugcucu

SEQ ID NO: 1966 - RNA, 22 nt, Homo Sapiens
aacacguaguagguguucgaua

SEQ ID NO: 1967 - RNA, 22 nt, Homo Sapiens
gagcuaaggauagaggugagga

SEQ ID NO: 1968 - RNA, 22 nt, Homo Sapiens
cuggcucccucucuucucuccc

SEQ ID NO: 1969 - RNA, 22 nt, Homo Sapiens
cuuggcccugugaggcuucacc

SEQ ID NO: 1970 - RNA, 22 nt, Homo Sapiens
cuggugaggaaggagcagaguu

SEQ ID NO: 1971 - RNA, 22 nt, Homo Sapiens
cugugcccagccagggcugugu

SEQ ID NO: 1972 - RNA, 22 nt, Homo Sapiens
cucacugcaaccuccgccuccc

SEQ ID NO: 1973 - RNA, 22 nt, Homo Sapiens
cucagugugaagaacuacgggu

SEQ ID NO: 1974 - RNA, 22 nt, Homo Sapiens
cagaggaugcggcugggaacgg

SEQ ID NO: 1975 - RNA, 22 nt, Homo Sapiens
ccccaccccaguggagcucacc

SEQ ID NO: 1976 - RNA, 22 nt, Homo Sapiens
gaggagguggggcagcagcagg

SEQ ID NO: 1977 - RNA, 22 nt, Homo Sapiens
gauggcagcuggagguggagca

SEQ ID NO: 1978 - RNA, 22 nt, Homo Sapiens
gguccacaaggggagagcaggg

SEQ ID NO: 1979 - RNA, 19 nt, Homo Sapiens
gggggaugauagcagccag

SEQ ID NO: 1980 - RNA, 22 nt, Homo Sapiens
ggcgugaucuuggcucaccaca

SEQ ID NO: 1981 - RNA, 22 nt, Homo Sapiens
ggcaacaugcugaaaccccagc

SEQ ID NO: 1982 - RNA, 22 nt, Homo Sapiens
ggaagaaugugcuuuuguuguu

SEQ ID NO: 1983 - RNA, 22 nt, Homo Sapiens
uagugcaauggcgcgaucucgg

SEQ ID NO: 1984 - RNA, 22 nt, Homo Sapiens
ucacugcaaccucugcuucugg

SEQ ID NO: 1985 - RNA, 22 nt, Homo Sapiens
ucacugcaaccucugccuuccg

SEQ ID NO: 1986 - RNA, 22 nt, Homo Sapiens
ucccugagcccugaaggguguu

SEQ ID NO: 1987 - RNA, 22 nt, Homo Sapiens
ugaaagagauguggugugugaa

SEQ ID NO: 1988 - RNA, 22 nt, Homo Sapiens
ugauccucuggcuucagccucc

SEQ ID NO: 1989 - RNA, 22 nt, Homo Sapiens
uguaugcucugugaagcuuacu

SEQ ID NO: 1990 - RNA, 22 nt, Homo Sapiens
uucccagaaaccugugagugug

SEQ ID NO: 1991 - RNA, 22 nt, Homo Sapiens
gaggagguggggcagcagcagg

SEQ ID NO: 1992 - RNA, 22 nt, Homo Sapiens
cucugccucccgggucuaggcu

SEQ ID NO: 1993 - RNA, 22 nt, Homo Sapiens
cugugcccagccagggcugugu

SEQ ID NO: 1994 - RNA, 22 nt, Homo Sapiens
cugggauuacaggugugaacca

SEQ ID NO: 1995 - RNA, 22 nt, Homo Sapiens
ccaaagugcugggauuacaggc

SEQ ID NO: 1996 - RNA, 22 nt, Homo Sapiens
ccaaagugcuaggauuacagcc

SEQ ID NO: 1997 - RNA, 22 nt, Homo Sapiens
ccaaagugcuaggaauacaggu

SEQ ID NO: 1998 - RNA, 22 nt, Homo Sapiens
ccaaagugcuggcguuacaggu

SEQ ID NO: 1999 - RNA, 22 nt, Homo Sapiens
cacugggauuacagaugugagc

SEQ ID NO: 2000 - RNA, 22 nt, Homo Sapiens
caaagugcugagauuacaggca

SEQ ID NO: 2001 - RNA, 22 nt, Homo Sapiens
cacugcaaccucugccaccugg

SEQ ID NO: 2002 - RNA, 22 nt, Homo Sapiens
cacugcaaccucugccuccugg

SEQ ID NO: 2003 - RNA, 22 nt, Homo Sapiens
acaaccucugccuccuggguuc

SEQ ID NO: 2004 - RNA, 22 nt, Homo Sapiens
aagugcugguauuacaagugug

SEQ ID NO: 2005 - RNA, 22 nt, Homo Sapiens
aagugcugggauuacaggccug

SEQ ID NO: 2006 - RNA, 22 nt, Homo Sapiens
acuggcacagacaucugucaag

SEQ ID NO: 2007 - RNA, 22 nt, Homo Sapiens
agugauuuuccugccucagccu

SEQ ID NO: 2008 - RNA, 22 nt, Homo Sapiens
uuuuuguggaauauuuuuuuaa

SEQ ID NO: 2009 - RNA, 22 nt, Homo Sapiens
uugguuggugaugagcauugaa

SEQ ID NO: 2010 - RNA, 22 nt, Homo Sapiens
uugguugcugaugagcuuugag

SEQ ID NO: 2011 - RNA, 22 nt, Homo Sapiens
uucuggugaauucaggauggua

SEQ ID NO: 2012 - RNA, 22 nt, Homo Sapiens
uuugcaguguucaucaguauuu

SEQ ID NO: 2013 - RNA, 22 nt, Homo Sapiens
aggcugcaguguaguggcauga

SEQ ID NO: 2014 - RNA, 22 nt, Homo Sapiens
agcagcacagaaauauuggcac

SEQ ID NO: 2015 - RNA, 22 nt, Homo Sapiens
auuuggggaaauguguuucugg

SEQ ID NO: 2016 - RNA, 22 nt, Homo Sapiens
cauaaaaucagaaaguauuacu

SEQ ID NO: 2017 - RNA, 22 nt, Homo Sapiens
cucacugcaaccuccgccuccc

SEQ ID NO: 2018 - RNA, 22 nt, Homo Sapiens
ugcagccuugaacucuuucugg

SEQ ID NO: 2019 - RNA, 22 nt, Homo Sapiens
ucacugcaaccucugccuuccg

SEQ ID NO: 2020 - RNA, 22 nt, Homo Sapiens
uacgcugugcugugacauggua

SEQ ID NO: 2021 - RNA, 22 nt, Homo Sapiens
uaagugcugcugauuuuggaaa

SEQ ID NO: 2022 - RNA, 22 nt, Homo Sapiens
gucuuccagccuccaucuuucu

SEQ ID NO: 2023 - RNA, 22 nt, Homo Sapiens
guggcauuggugguggcauugg

SEQ ID NO: 2024 - RNA, 22 nt, Homo Sapiens
gcugcugccucaacauuuuagg

SEQ ID NO: 2025 - RNA, 22 nt, Homo Sapiens
gcuucuccuguccccucccuac

SEQ ID NO: 2026 - RNA, 22 nt, Homo Sapiens
gugggcugagaaaggcugccca

SEQ ID NO: 2027 - RNA, 22 nt, Homo Sapiens
ugacuggaggaagggagguaag

SEQ ID NO: 2028 - RNA, 22 nt, Homo Sapiens
uccagugauucauuugguuguu

SEQ ID NO: 2029 - RNA, 21 nt, Homo Sapiens
gacacaggcccagagaggcag

SEQ ID NO: 2030 - RNA, 22 nt, Homo Sapiens
agcuccaggagcuggcaggagg

SEQ ID NO: 2031 - RNA, 22 nt, Homo Sapiens
aggcugagugacugggaguuag

SEQ ID NO: 2032 - RNA, 22 nt, Homo Sapiens
agguggcacugugugggguggg

SEQ ID NO: 2033 - RNA, 22 nt, Homo Sapiens
agaaggcucgcucucucagggg

SEQ ID NO: 2034 - RNA, 20 nt, Homo Sapiens
acaggagcauggagaggcua

SEQ ID NO: 2035 - RNA, 22 nt, Homo Sapiens
acacaggcccagagaggcagug

SEQ ID NO: 2036 - RNA, 22 nt, Homo Sapiens
uuuguaauagcaaaauacugga

SEQ ID NO: 2037 - RNA, 22 nt, Homo Sapiens
accacagugucacagaguccau

SEQ ID NO: 2038 - RNA, 22 nt, Homo Sapiens
accuggccuguaggcaagucuu

SEQ ID NO: 2039 - RNA, 22 nt, Homo Sapiens
agucagggagacugucaguaaa

SEQ ID NO: 2040 - RNA, 22 nt, Homo Sapiens
auaccagcacaguggaugggga

SEQ ID NO: 2041 - RNA, 22 nt, Homo Sapiens
aggccagagaggacucucuuuu

SEQ ID NO: 2042 - RNA, 22 nt, Homo Sapiens
agauauggugaacagacagaug

SEQ ID NO: 2043 - RNA, 22 nt, Homo Sapiens
gaggacccuuaggucagacaga

SEQ ID NO: 2044 - RNA, 22 nt, Homo Sapiens
gagguuugagccuucuccugcu

SEQ ID NO: 2045 - RNA, 22 nt, Homo Sapiens
cuggcucccucucuucucuccc

SEQ ID NO: 2046 - RNA, 22 nt, Homo Sapiens
cacugcaacccccgccucccag

SEQ ID NO: 2047 - RNA, 22 nt, Homo Sapiens
ccagccugagguuccuggaggg

SEQ ID NO: 2048 - RNA, 22 nt, Homo Sapiens
cggcaagaugccggagugcugg

SEQ ID NO: 2049 - RNA, 22 nt, Homo Sapiens
cuagcacagugcuuggcacaca

SEQ ID NO: 2050 - RNA, 22 nt, Homo Sapiens
ucuuucuacaccucugccagug

SEQ ID NO: 2051 - RNA, 22 nt, Homo Sapiens
ucuuccccaccuucggcuugca

SEQ ID NO: 2052 - RNA, 22 nt, Homo Sapiens
ucucauauagcuggguugcagc

SEQ ID NO: 2053 - RNA, 22 nt, Homo Sapiens
ugacuggaggaagggagguaag

SEQ ID NO: 2054 - RNA, 22 nt, Homo Sapiens
ugccuaggcaggacggaaugca

SEQ ID NO: 2055 - RNA, 22 nt, Homo Sapiens
uucaguucuugaccugccccag

SEQ ID NO: 2056 - RNA, 22 nt, Homo Sapiens
ugggaugauguuaaacguacuc

SEQ ID NO: 2057 - RNA, 22 nt, Homo Sapiens
ugguccagaggaggaaugaggg

SEQ ID NO: 2058 - RNA, 22 nt, Homo Sapiens
uggaggcaggugcagauggagg

SEQ ID NO: 2059 - RNA, 22 nt, Homo Sapiens
ugcuaggcuuauucucuuccuc

SEQ ID NO: 2060 - RNA, 22 nt, Homo Sapiens
uaagaagagaaagaagaggcug

SEQ ID NO: 2061 - RNA, 22 nt, Homo Sapiens
gucuuccuccguccccaccucc

SEQ ID NO: 2062 - RNA, 22 nt, Homo Sapiens
gguucucaaaugagggacauuu

SEQ ID NO: 2063 - RNA, 22 nt, Homo Sapiens
uacaggcaggcacagaggcagu

SEQ ID NO: 2064 - RNA, 22 nt, Homo Sapiens
ucacugcaaccucugccuuccg

SEQ ID NO: 2065 - RNA, 22 nt, Homo Sapiens
gcuucuccuguccccucccuac

SEQ ID NO: 2066 - RNA, 22 nt, Homo Sapiens
gcagcaggcagggccaggcagg

SEQ ID NO: 2067 - RNA, 22 nt, Homo Sapiens
gcugagaccacccuugccugcc

SEQ ID NO: 2068 - RNA, 22 nt, Homo Sapiens
gggagaaaaggaggggauacag

SEQ ID NO: 2069 - RNA, 22 nt, Homo Sapiens
gggucucaaaugagggacauuu

SEQ ID NO: 2070 - RNA, 22 nt, Homo Sapiens
gggguuucuguaggcacuuuau

SEQ ID NO: 2071 - RNA, 22 nt, Homo Sapiens
ggcagcugugcagagugggggu

SEQ ID NO: 2072 - RNA, 22 nt, Homo Sapiens
ucacccaggcuggagugcagug

SEQ ID NO: 2073 - RNA, 22 nt, Homo Sapiens
uagcucauuuuugaaaucaguu

SEQ ID NO: 2074 - RNA, 22 nt, Homo Sapiens
gugggcugagaaaggcugccca

SEQ ID NO: 2075 - RNA, 22 nt, Homo Sapiens
uucaagaaagccaagauggcug

SEQ ID NO: 2076 - RNA, 22 nt, Homo Sapiens
uuaaagucaccauuuguggguu

SEQ ID NO: 2077 - RNA, 22 nt, Homo Sapiens
ugcaugaugcugagguuuggga

SEQ ID NO: 2078 - RNA, 22 nt, Homo Sapiens
ugaguauucaccaggugcuggg

SEQ ID NO: 2079 - RNA, 22 nt, Homo Sapiens
ugagguaggugcugaaacugcu

SEQ ID NO: 2080 - RNA, 22 nt, Homo Sapiens
ucugccucccugucucacucuc

SEQ ID NO: 2081 - RNA, 22 nt, Homo Sapiens
ccugggggccacuuugcacagg

SEQ ID NO: 2082 - RNA, 22 nt, Homo Sapiens
cccaggcuggagugcaguggug

SEQ ID NO: 2083 - RNA, 22 nt, Homo Sapiens
cuggcucuaauaaccugagcuu

SEQ ID NO: 2084 - RNA, 22 nt, Homo Sapiens
cugugcccagccagggcugugu

SEQ ID NO: 2085 - RNA, 22 nt, Homo Sapiens
cucacugcaaccuccgccuccc

SEQ ID NO: 2086 - RNA, 22 nt, Homo Sapiens
agcuggauuguuuaccuggggc

SEQ ID NO: 2087 - RNA, 22 nt, Homo Sapiens
aggcacugugcaggaugauggg

SEQ ID NO: 2088 - RNA, 22 nt, Homo Sapiens
aguauuucuuguuuuauugaga

SEQ ID NO: 2089 - RNA, 22 nt, Homo Sapiens
accuggccuguaggcaagucuu

SEQ ID NO: 2090 - RNA, 22 nt, Homo Sapiens
aagcagaacuguuuuguuuucu

SEQ ID NO: 2091 - RNA, 22 nt, Homo Sapiens
uugccuaggcuggagugcagug

SEQ ID NO: 2092 - RNA, 22 nt, Homo Sapiens
uugcccaggcuggagugcagug

SEQ ID NO: 2093 - RNA, 22 nt, Homo Sapiens
aggccagagaggacucucuuuu

SEQ ID NO: 2094 - RNA, 22 nt, Homo Sapiens
ugagagagcaagugaauuuccc

SEQ ID NO: 2095 - RNA, 22 nt, Homo Sapiens
ugcaugaugcugagguuuggga

SEQ ID NO: 2096 - RNA, 22 nt, Homo Sapiens
ugugcugguugcccccgagggg

SEQ ID NO: 2097 - RNA, 22 nt, Homo Sapiens
uaagauguuugcauuucagcac

SEQ ID NO: 2098 - RNA, 22 nt, Homo Sapiens
uauugcuaagaauucagguagu

SEQ ID NO: 2099 - RNA, 22 nt, Homo Sapiens
ggcuagaaagccagagagacag

SEQ ID NO: 2100 - RNA, 22 nt, Homo Sapiens
ggcuggagaguaaaucaggucu

SEQ ID NO: 2101 - RNA, 22 nt, Homo Sapiens
ggcccaggagggggagaaaggc

SEQ ID NO: 2102 - RNA, 22 nt, Homo Sapiens
gcuucuccuguccccucccuac

SEQ ID NO: 2103 - RNA, 22 nt, Homo Sapiens
gccuuuccuccagaacugcucc

SEQ ID NO: 2104 - RNA, 22 nt, Homo Sapiens
ggaggaggaggcuggugcuggu

SEQ ID NO: 2105 - RNA, 22 nt, Homo Sapiens
guugggguuucaguggcaguca

SEQ ID NO: 2106 - RNA, 22 nt, Homo Sapiens
uguguuggagcagaggcagggg

SEQ ID NO: 2107 - RNA, 22 nt, Homo Sapiens
uucacaguggcugaagcuguuc

SEQ ID NO: 2108 - RNA, 22 nt, Homo Sapiens
uuaguguucaggcucaaaugaa

SEQ ID NO: 2109 - RNA, 22 nt, Homo Sapiens
ugguccagaggaggaaugaggg

SEQ ID NO: 2110 - RNA, 22 nt, Homo Sapiens
uggcacagaucagcagaacagg

SEQ ID NO: 2111 - RNA, 22 nt, Homo Sapiens
ucugagcccaggaguuugaggc

SEQ ID NO: 2112 - RNA, 22 nt, Homo Sapiens
ucuuagauugagaagauguggc

SEQ ID NO: 2113 - RNA, 22 nt, Homo Sapiens
ucuuucuacaccucugccagug

SEQ ID NO: 2114 - RNA, 22 nt, Homo Sapiens
agggcaguggaucucugcaaag

SEQ ID NO: 2115 - RNA, 22 nt, Homo Sapiens
agguccucacacacagcucugc

SEQ ID NO: 2116 - RNA, 22 nt, Homo Sapiens
cugugggugagagagugggaga

SEQ ID NO: 2117 - RNA, 22 nt, Homo Sapiens
gaguacaaaugaagucuguggg

SEQ ID NO: 2118 - RNA, 22 nt, Homo Sapiens
gaggagguggggcagcagcagg

SEQ ID NO: 2119 - RNA, 21 nt, Homo Sapiens
cuuuggcaagggagaagucac

SEQ ID NO: 2120 - RNA, 22 nt, Homo Sapiens
cccaggagguggagguuacagu

SEQ ID NO: 2121 - RNA, 22 nt, Homo Sapiens
cacugcaaccucugccuccugg

SEQ ID NO: 2122 - RNA, 22 nt, Homo Sapiens
cacugcaaccucugccaccugg

SEQ ID NO: 2123 - RNA, 22 nt, Homo Sapiens
cacugcaaccuccaccuccugg

SEQ ID NO: 2124 - RNA, 22 nt, Homo Sapiens
cagagcugccuuucccuuccug

SEQ ID NO: 2125 - RNA, 22 nt, Homo Sapiens
uuguugcggguggggagaggau

SEQ ID NO: 2126 - RNA, 22 nt, Homo Sapiens
uuuucugggcucccuuuucugc

SEQ ID NO: 2127 - RNA, 22 nt, Homo Sapiens
uuuucugggcucccuuuucugc

SEQ ID NO: 2128 - RNA, 22 nt, Homo Sapiens
uuuguaauagcaaaauacugga

SEQ ID NO: 2129 - RNA, 22 nt, Homo Sapiens
uucuggugaauucaggauggua

SEQ ID NO: 2130 - RNA, 22 nt, Homo Sapiens
uucuaugauucucuaaguagca

SEQ ID NO: 2131 - RNA, 22 nt, Homo Sapiens
uucuuuuuccgcuuucugagcc

SEQ ID NO: 2132 - RNA, 22 nt, Homo Sapiens
uucucccugcccacacauccag

SEQ ID NO: 2133 - RNA, 22 nt, Homo Sapiens
uugagcaaaauaucugguuuca

SEQ ID NO: 2134 - RNA, 22 nt, Homo Sapiens
ccagaggugagucuugauuuug

SEQ ID NO: 2135 - RNA, 22 nt, Homo Sapiens
gacaugauguagcagaugaugg

SEQ ID NO: 2136 - RNA, 22 nt, Homo Sapiens
gauguugaugagcuugugugca

SEQ ID NO: 2137 - RNA, 22 nt, Homo Sapiens
cugugggugagagagugggaga

SEQ ID NO: 2138 - RNA, 22 nt, Homo Sapiens
cucugagucugagagaguaggu

SEQ ID NO: 2139 - RNA, 22 nt, Homo Sapiens
aggcacugugcaggaugauggg

SEQ ID NO: 2140 - RNA, 22 nt, Homo Sapiens
auaaagcagguuaacaaagcug

SEQ ID NO: 2141 - RNA, 22 nt, Homo Sapiens
ucagguuccugauuggaguucu

SEQ ID NO: 2142 - RNA, 22 nt, Homo Sapiens
ugguggggagaggcuugggaag

SEQ ID NO: 2143 - RNA, 22 nt, Homo Sapiens
uggagugucuggaggugucucu

SEQ ID NO: 2144 - RNA, 22 nt, Homo Sapiens
uguguacuugucuuaguuugcu

SEQ ID NO: 2145 - RNA, 22 nt, Homo Sapiens
gucuggaggcuggaaccuggug

SEQ ID NO: 2146 - RNA, 22 nt, Homo Sapiens
uaucacgugcagcuuugcugac

SEQ ID NO: 2147 - RNA, 22 nt, Homo Sapiens
uagguugugcgcuccuuaugag

SEQ ID NO: 2148 - RNA, 22 nt, Homo Sapiens
uaaguaaagagagaagccagaa

SEQ ID NO: 2149 - RNA, 22 nt, Homo Sapiens
ggcagcugugcagagugggggu

SEQ ID NO: 2150 - RNA, 22 nt, Homo Sapiens
gcuucuccuguccccucccuac

SEQ ID NO: 2151 - RNA, 22 nt, Homo Sapiens
uacaaauuccugggucuccugg

SEQ ID NO: 2152 - RNA, 22 nt, Homo Sapiens
ucuuugcuggaaggugccuccc

SEQ ID NO: 2153 - RNA, 22 nt, Homo Sapiens
acugggauaugaagacugugug

SEQ ID NO: 2154 - RNA, 22 nt, Homo Sapiens
uucuggguuuuuguggguuugc

SEQ ID NO: 2155 - RNA, 22 nt, Homo Sapiens
uucccucauucuccacccaguc

SEQ ID NO: 2156 - RNA, 22 nt, Homo Sapiens
acugcacuccauccuggggagc

SEQ ID NO: 2157 - RNA, 22 nt, Homo Sapiens
cuggcucuacccucucacuuca

SEQ ID NO: 2158 - RNA, 22 nt, Homo Sapiens
cuggguggccuucaguccauga

SEQ ID NO: 2159 - RNA, 22 nt, Homo Sapiens
ccaaagugcuggcguuacaggu

SEQ ID NO: 2160 - RNA, 22 nt, Homo Sapiens
ccuggagugacagguguagccu

SEQ ID NO: 2161 - RNA, 22 nt, Homo Sapiens
cuagcacagugcuuggcacaca

SEQ ID NO: 2162 - RNA, 22 nt, Homo Sapiens
ucccuucagagcccauggguuu

SEQ ID NO: 2163 - RNA, 22 nt, Homo Sapiens
uguggcuaguuugaacugagau

SEQ ID NO: 2164 - RNA, 22 nt, Homo Sapiens
uggagugucuggaggugucucu

SEQ ID NO: 2165 - RNA, 22 nt, Homo Sapiens
uggagaaauuauauuuuacuaa

SEQ ID NO: 2166 - RNA, 22 nt, Homo Sapiens
uaaggagugguuccaauuuggg

SEQ ID NO: 2167 - RNA, 22 nt, Homo Sapiens
uaggagugaaaauaaacucugu

SEQ ID NO: 2168 - RNA, 22 nt, Homo Sapiens
ucacccaguguaaacagcauga

SEQ ID NO: 2169 - RNA, 22 nt, Homo Sapiens
guauggagaucucugcccuugu

SEQ ID NO: 2170 - RNA, 22 nt, Homo Sapiens
gguucucaaaugagggacauuu

SEQ ID NO: 2171 - RNA, 22 nt, Homo Sapiens
gcaggugugcaaaucacaacuu

SEQ ID NO: 2172 - RNA, 22 nt, Homo Sapiens
ggcaugauggagaggguggaga

SEQ ID NO: 2173 - RNA, 22 nt, Homo Sapiens
guggaguucucugcuaguccua

SEQ ID NO: 2174 - RNA, 22 nt, Homo Sapiens
uucaggacuguggacugggcug

SEQ ID NO: 2175 - RNA, 22 nt, Homo Sapiens
cugcacuagaaggcacuauguu

SEQ ID NO: 2176 - RNA, 22 nt, Homo Sapiens
gacaagaggcacagacagcagg

SEQ ID NO: 2177 - RNA, 22 nt, Homo Sapiens
agaaggcucgcucucucagggg

SEQ ID NO: 2178 - RNA, 22 nt, Homo Sapiens
augggcaaauacugggagcugg

SEQ ID NO: 2179 - RNA, 22 nt, Homo Sapiens
agcaccacaacagggacugggc

SEQ ID NO: 2180 - RNA, 22 nt, Homo Sapiens
agauaguucucuguuguugggg

SEQ ID NO: 2181 - RNA, 22 nt, Homo Sapiens
agaggcagagguuacaguagug

SEQ ID NO: 2182 - RNA, 22 nt, Homo Sapiens
aggcaagagguugcagugagcu

SEQ ID NO: 2183 - RNA, 22 nt, Homo Sapiens
agguccucacacacagcucugc

SEQ ID NO: 2184 - RNA, 22 nt, Homo Sapiens
aggcugcaguguaguggcauga

SEQ ID NO: 2185 - RNA, 22 nt, Homo Sapiens
auugcacuucagccugggugac

SEQ ID NO: 2186 - RNA, 22 nt, Homo Sapiens
auugcacuccagcuugggcaac

SEQ ID NO: 2187 - RNA, 22 nt, Homo Sapiens
auugcacuccagccugggugac

SEQ ID NO: 2188 - RNA, 22 nt, Homo Sapiens
auugcacuccagccugggcaau

SEQ ID NO: 2189 - RNA, 22 nt, Homo Sapiens
augccacagcacuucagccuga

SEQ ID NO: 2190 - RNA, 22 nt, Homo Sapiens
augccuguaaucccagcacuuu

SEQ ID NO: 2191 - RNA, 22 nt, Homo Sapiens
augccuguaaucccagcauuuu

SEQ ID NO: 2192 - RNA, 22 nt, Homo Sapiens
augaccaggaauugagagacug

SEQ ID NO: 2193 - RNA, 22 nt, Homo Sapiens
agugagccgagauacauacaua

SEQ ID NO: 2194 - RNA, 22 nt, Homo Sapiens
agugagcuaugaucaugccggu

SEQ ID NO: 2195 - RNA, 22 nt, Homo Sapiens
agaaggcucgcucucucagggg

SEQ ID NO: 2196 - RNA, 22 nt, Homo Sapiens
acuguacuucagccuggguaac

SEQ ID NO: 2197 - RNA, 22 nt, Homo Sapiens
acuguacuccagccugggcaac

SEQ ID NO: 2198 - RNA, 22 nt, Homo Sapiens
acuguacuucagccugggcaac

SEQ ID NO: 2199 - RNA, 22 nt, Homo Sapiens
acuguacuccagccuaggcaac

SEQ ID NO: 2200 - RNA, 22 nt, Homo Sapiens
acuguacuccagccugggugac

SEQ ID NO: 2201 - RNA, 22 nt, Homo Sapiens
acugcacuccauccuggggagc

SEQ ID NO: 2202 - RNA, 22 nt, Homo Sapiens
acugcacuccugccuaggugac

SEQ ID NO: 2203 - RNA, 22 nt, Homo Sapiens
acugcacuccugccugggugac

SEQ ID NO: 2204 - RNA, 22 nt, Homo Sapiens
acugcacucuagccuaggugau

SEQ ID NO: 2205 - RNA, 22 nt, Homo Sapiens
acugcacucuagccugagcaac

SEQ ID NO: 2206 - RNA, 22 nt, Homo Sapiens
acugcacuucagccugggcaau

SEQ ID NO: 2207 - RNA, 22 nt, Homo Sapiens
acugcacucuagccugggcaac

SEQ ID NO: 2208 - RNA, 22 nt, Homo Sapiens
acugcacuccagccuaugggau

SEQ ID NO: 2209 - RNA, 22 nt, Homo Sapiens
acugcacuccagccuggcaaca

SEQ ID NO: 2210 - RNA, 22 nt, Homo Sapiens
acugcacuccagccuggguggc

SEQ ID NO: 2211 - RNA, 22 nt, Homo Sapiens
acugcacuccagccugggugac

SEQ ID NO: 2212 - RNA, 22 nt, Homo Sapiens
acugcacuccagccugggugau

SEQ ID NO: 2213 - RNA, 22 nt, Homo Sapiens
acugcacuccagccugggcgau

SEQ ID NO: 2214 - RNA, 22 nt, Homo Sapiens
acugcacuccagccuggcgaca

SEQ ID NO: 2215 - RNA, 22 nt, Homo Sapiens
acugcacuccagccuguugaca

SEQ ID NO: 2216 - RNA, 22 nt, Homo Sapiens
acugcacuccagucuaggugac

SEQ ID NO: 2217 - RNA, 22 nt, Homo Sapiens
acugcacuccagucugggugac

SEQ ID NO: 2218 - RNA, 22 nt, Homo Sapiens
acugcacuccauccugggacag

SEQ ID NO: 2219 - RNA, 22 nt, Homo Sapiens
acugcacuccauccugagugac

SEQ ID NO: 2220 - RNA, 22 nt, Homo Sapiens
aacccuggaggcagagguugcg

SEQ ID NO: 2221 - RNA, 22 nt, Homo Sapiens
aaagcuuuguucauuguaucug

SEQ ID NO: 2222 - RNA, 22 nt, Homo Sapiens
acaaaaaauacgaaaauuagcu

SEQ ID NO: 2223 - RNA, 22 nt, Homo Sapiens
aaugugaauguuguaugcagug

SEQ ID NO: 2224 - RNA, 22 nt, Homo Sapiens
aagguggugucauguuuugggg

SEQ ID NO: 2225 - RNA, 22 nt, Homo Sapiens
aaucccagcuacucgggaggcu

SEQ ID NO: 2226 - RNA, 22 nt, Homo Sapiens
gaccagccauccugguuuacau

SEQ ID NO: 2227 - RNA, 22 nt, Homo Sapiens
gagguagagguugcagugagug

SEQ ID NO: 2228 - RNA, 22 nt, Homo Sapiens
gagguagagguugcagugaguc

SEQ ID NO: 2229 - RNA, 22 nt, Homo Sapiens
cugaggucaggaguucgagacc

SEQ ID NO: 2230 - RNA, 22 nt, Homo Sapiens
cucugagucugagagaguaggu

SEQ ID NO: 2231 - RNA, 22 nt, Homo Sapiens
cucagauacuugggagguugag

SEQ ID NO: 2232 - RNA, 22 nt, Homo Sapiens
cuggaggauaacaaugauaaug

SEQ ID NO: 2233 - RNA, 22 nt, Homo Sapiens
cuugcacuccacagccugggug

SEQ ID NO: 2234 - RNA, 22 nt, Homo Sapiens
cugugcccagccagggcugugu

SEQ ID NO: 2235 - RNA, 22 nt, Homo Sapiens
cguguaaucccagcuacuuggg

SEQ ID NO: 2236 - RNA, 22 nt, Homo Sapiens
cccaggagguggagguuacagu

SEQ ID NO: 2237 - RNA, 22 nt, Homo Sapiens
ccuccuuucaucaaauucgagu

SEQ ID NO: 2238 - RNA, 22 nt, Homo Sapiens
cauugcacuccagccuggguga

SEQ ID NO: 2239 - RNA, 22 nt, Homo Sapiens
cauugcacuccagccuaggcaa

SEQ ID NO: 2240 - RNA, 22 nt, Homo Sapiens
cauugcacuccacccuaggcaa

SEQ ID NO: 2241 - RNA, 22 nt, Homo Sapiens
cccaggaggcggagguugcagu

SEQ ID NO: 2242 - RNA, 22 nt, Homo Sapiens
ccagccugagguuccuggaggg

SEQ ID NO: 2243 - RNA, 22 nt, Homo Sapiens
ccacugcacuccagccugggug

SEQ ID NO: 2244 - RNA, 22 nt, Homo Sapiens
cacugcacuccaaccuggacaa

SEQ ID NO: 2245 - RNA, 22 nt, Homo Sapiens
cacugcacucuagccucgguga

SEQ ID NO: 2246 - RNA, 22 nt, Homo Sapiens
cacugcacuguagccuccuggg

SEQ ID NO: 2247 - RNA, 22 nt, Homo Sapiens
cacugcacuccagccuggguga

SEQ ID NO: 2248 - RNA, 22 nt, Homo Sapiens
cacugcacuccagccuggguaa

SEQ ID NO: 2249 - RNA, 22 nt, Homo Sapiens
cacugcacuccagccugggcga

SEQ ID NO: 2250 - RNA, 22 nt, Homo Sapiens
cacugcacuccagccuaggcaa

SEQ ID NO: 2251 - RNA, 22 nt, Homo Sapiens
cacugcaaccucugccuccugg

SEQ ID NO: 2252 - RNA, 22 nt, Homo Sapiens
cacugcacuccacccugggcaa

SEQ ID NO: 2253 - RNA, 22 nt, Homo Sapiens
cacugcacuccagcccggcaac

SEQ ID NO: 2254 - RNA, 22 nt, Homo Sapiens
cacugcacucagccugggugac

SEQ ID NO: 2255 - RNA, 22 nt, Homo Sapiens
auuguucuccagccugggcgac

SEQ ID NO: 2256 - RNA, 22 nt, Homo Sapiens
auugcuugagcccaggaguuca

SEQ ID NO: 2257 - RNA, 22 nt, Homo Sapiens
auugcacaccaaccugggcaac

SEQ ID NO: 2258 - RNA, 22 nt, Homo Sapiens
caagugcuugaacauggcagag

SEQ ID NO: 2259 - RNA, 21 nt, Homo Sapiens
uucacccaucuuuccacccac

SEQ ID NO: 2260 - RNA, 22 nt, Homo Sapiens
ugugccacugcacuccaugggu

SEQ ID NO: 2261 - RNA, 22 nt, Homo Sapiens
ugugacucguacuuguaauccu

SEQ ID NO: 2262 - RNA, 22 nt, Homo Sapiens
ugcucuugcucuuucuucugga

SEQ ID NO: 2263 - RNA, 22 nt, Homo Sapiens
ugcugugcuaaaggaaggauua

SEQ ID NO: 2264 - RNA, 22 nt, Homo Sapiens
uggagccuuguuguuuguucac

SEQ ID NO: 2265 - RNA, 22 nt, Homo Sapiens
uggagcagaaaggcaggagucc

SEQ ID NO: 2266 - RNA, 22 nt, Homo Sapiens
ugggaaacauccagcacauacu

SEQ ID NO: 2267 - RNA, 22 nt, Homo Sapiens
ucccuucagagcccauggguuu

SEQ ID NO: 2268 - RNA, 22 nt, Homo Sapiens
uccauugcacuccagucugggc

SEQ ID NO: 2269 - RNA, 22 nt, Homo Sapiens
ucugucauuuuucucuuuccau

SEQ ID NO: 2270 - RNA, 22 nt, Homo Sapiens
ucugagcccaggaguuugaggc

SEQ ID NO: 2271 - RNA, 22 nt, Homo Sapiens
ucucacacucugauuucuugcu

SEQ ID NO: 2272 - RNA, 22 nt, Homo Sapiens
ugcgccccuguacucugggcaa

SEQ ID NO: 2273 - RNA, 22 nt, Homo Sapiens
ugcaccaaugcacuccagccug

SEQ ID NO: 2274 - RNA, 22 nt, Homo Sapiens
ugcaccacugcacuccagccug

SEQ ID NO: 2275 - RNA, 22 nt, Homo Sapiens
ugcaccacugcacucuaaccug

SEQ ID NO: 2276 - RNA, 22 nt, Homo Sapiens
ugauucauuucuaaacccagcu

SEQ ID NO: 2277 - RNA, 22 nt, Homo Sapiens
gugcuugaccaugugguggcag

SEQ ID NO: 2278 - RNA, 22 nt, Homo Sapiens
guggcauuggugguggcauugg

SEQ ID NO: 2279 - RNA, 22 nt, Homo Sapiens
gugugggcagggccgugcuccc

SEQ ID NO: 2280 - RNA, 22 nt, Homo Sapiens
guacacauuuucauguuaccau

SEQ ID NO: 2281 - RNA, 22 nt, Homo Sapiens
guacuccagccugccuggguaa

SEQ ID NO: 2282 - RNA, 22 nt, Homo Sapiens
uaucgcuugagcccaggaguuu

SEQ ID NO: 2283 - RNA, 22 nt, Homo Sapiens
uauugcacuccagccugggcaa

SEQ ID NO: 2284 - RNA, 22 nt, Homo Sapiens
uauggcaaagucacugauuucc

SEQ ID NO: 2285 - RNA, 22 nt, Homo Sapiens
uaggagugaaaauaaacucugu

SEQ ID NO: 2286 - RNA, 22 nt, Homo Sapiens
uacaugugcccaguggcugcug

SEQ ID NO: 2287 - RNA, 22 nt, Homo Sapiens
uaccagugucagcuuccugugu

SEQ ID NO: 2288 - RNA, 22 nt, Homo Sapiens
ggcccaggagggggagaaaggc

SEQ ID NO: 2289 - RNA, 22 nt, Homo Sapiens
ggcaacaugcugaaaccccagc

SEQ ID NO: 2290 - RNA, 22 nt, Homo Sapiens
ggcugggcaugguggcucacgc

SEQ ID NO: 2291 - RNA, 22 nt, Homo Sapiens
ggcugcagugaacuaugaucgu

SEQ ID NO: 2292 - RNA, 22 nt, Homo Sapiens
ggccugguggcuguuguuuugg

SEQ ID NO: 2293 - RNA, 22 nt, Homo Sapiens
ggccugaggucagcaguagagg

SEQ ID NO: 2294 - RNA, 22 nt, Homo Sapiens
gggcaugaugauggcacuagcg

SEQ ID NO: 2295 - RNA, 22 nt, Homo Sapiens
gccauugcacuccagccuggac

SEQ ID NO: 2296 - RNA, 22 nt, Homo Sapiens
gccauugcacuccagccugggc

SEQ ID NO: 2297 - RNA, 22 nt, Homo Sapiens
gccuguaaucccagcuacuugg

SEQ ID NO: 2298 - RNA, 22 nt, Homo Sapiens
gcacucaagccuggguuacaga

SEQ ID NO: 2299 - RNA, 22 nt, Homo Sapiens
ggaggcagugguugcagugagc

SEQ ID NO: 2300 - RNA, 22 nt, Homo Sapiens
ggacugcagucacacucuaaga

SEQ ID NO: 2301 - RNA, 22 nt, Homo Sapiens
uucugccacugcauuccagccu

SEQ ID NO: 2302 - RNA, 22 nt, Homo Sapiens
uugagaaugcuguaauuggagg

SEQ ID NO: 2303 - RNA, 22 nt, Homo Sapiens
uugagcacaguuugaggagugu

SEQ ID NO: 2304 - RNA, 22 nt, Homo Sapiens
uugcaauagugaaaaaacugaa

SEQ ID NO: 2305 - RNA, 22 nt, Homo Sapiens
uugcacuccagccuggguaaca

SEQ ID NO: 2306 - RNA, 22 nt, Homo Sapiens
uugcacuccagucugggugaca

SEQ ID NO: 2307 - RNA, 22 nt, Homo Sapiens
uugcacuccagccugggugaca

SEQ ID NO: 2308 - RNA, 22 nt, Homo Sapiens
uuguuuuagaagaaggucagaa

SEQ ID NO: 2309 - RNA, 22 nt, Homo Sapiens
uuuaagcuauaguuccaggccc

SEQ ID NO: 2310 - RNA, 22 nt, Homo Sapiens
uuguugcggguggggagaggau

SEQ ID NO: 2311 - RNA, 22 nt, Homo Sapiens
uuugcacacuuuccaaguugcc

SEQ ID NO: 2312 - RNA, 22 nt, Homo Sapiens
ggagcuguaguuuuucccacau

SEQ ID NO: 2313 - RNA, 22 nt, Homo Sapiens
gcuguguuaacuguucaaacuc

SEQ ID NO: 2314 - RNA, 22 nt, Homo Sapiens
ggugaugcauuuaaaagggcag

SEQ ID NO: 2315 - RNA, 22 nt, Homo Sapiens
ggcuggagaguaaaucaggucu

SEQ ID NO: 2316 - RNA, 22 nt, Homo Sapiens
ucugucauuuuucucuuuccau

SEQ ID NO: 2317 - RNA, 22 nt, Homo Sapiens
uggcagauuugguugcuguugg

SEQ ID NO: 2318 - RNA, 22 nt, Homo Sapiens
uuccaguucucagcacagcgcu

SEQ ID NO: 2319 - RNA, 22 nt, Homo Sapiens
cugugagcuauuuguuuugguu

SEQ ID NO: 2320 - RNA, 22 nt, Homo Sapiens
gaacagcuccagucuacagccc

SEQ ID NO: 2321 - RNA, 22 nt, Homo Sapiens
acugcacuccugccuaggugac

SEQ ID NO: 2322 - RNA, 22 nt, Homo Sapiens
aggcagucuugauuagcuucua

SEQ ID NO: 2323 - RNA, 22 nt, Homo Sapiens
aggcagagagguauuuaggcau

SEQ ID NO: 2324 - RNA, 22 nt, Homo Sapiens
agcaagaugguagcauuggaga

SEQ ID NO: 2325 - RNA, 22 nt, Homo Sapiens
agcugguguguagcggguaccu

SEQ ID NO: 2326 - RNA, 22 nt, Homo Sapiens
agcugugagccugccuuccagu

SEQ ID NO: 2327 - RNA, 22 nt, Homo Sapiens
aggugggguuucaccauguugg

SEQ ID NO: 2328 - RNA, 22 nt, Homo Sapiens
augucagugaagaggucuggca

SEQ ID NO: 2329 - RNA, 22 nt, Homo Sapiens
acugcacuccagccuggguggc

SEQ ID NO: 2330 - RNA, 22 nt, Homo Sapiens
aagguggugucauguuuugggg

SEQ ID NO: 2331 - RNA, 22 nt, Homo Sapiens
aaggcuguguaggcagaauucu

SEQ ID NO: 2332 - RNA, 22 nt, Homo Sapiens
aauuuagaaucguuucugauag

SEQ ID NO: 2333 - RNA, 22 nt, Homo Sapiens
gacaagaggcacagacagcagg

SEQ ID NO: 2334 - RNA, 22 nt, Homo Sapiens
gaggagguggggcagcagcagg

SEQ ID NO: 2335 - RNA, 22 nt, Homo Sapiens
gagggaagcaugggaccaugau

SEQ ID NO: 2336 - RNA, 22 nt, Homo Sapiens
cugggcgugugaggcggcugug

SEQ ID NO: 2337 - RNA, 22 nt, Homo Sapiens
cucaccaguuacucuccaguug

SEQ ID NO: 2338 - RNA, 22 nt, Homo Sapiens
auuugaggaggcuuuacagcca

SEQ ID NO: 2339 - RNA, 22 nt, Homo Sapiens
cagagcugccuuucccuuccug

SEQ ID NO: 2340 - RNA, 22 nt, Homo Sapiens
ccugcccauccugccuccacca

SEQ ID NO: 2341 - RNA, 22 nt, Homo Sapiens
ccucuccauguacccauucccc

SEQ ID NO: 2342 - RNA, 22 nt, Homo Sapiens
uuccccaugugaugcuauugcu

SEQ ID NO: 2343 - RNA, 21 nt, Homo Sapiens
uucacccaucuuuccacccac

SEQ ID NO: 2344 - RNA, 22 nt, Homo Sapiens
uucacccaucuuuccacccacg

SEQ ID NO: 2345 - RNA, 22 nt, Homo Sapiens
uuagcaguugugagacccuaga

SEQ ID NO: 2346 - RNA, 22 nt, Homo Sapiens
uggauuaguaaagaagaaugaa

SEQ ID NO: 2347 - RNA, 22 nt, Homo Sapiens
ugggaagaugcuggcaaggugc

SEQ ID NO: 2348 - RNA, 22 nt, Homo Sapiens
ugguccagaggaggaaugaggg

SEQ ID NO: 2349 - RNA, 22 nt, Homo Sapiens
ugcuaggcuuauucucuuccuc

SEQ ID NO: 2350 - RNA, 22 nt, Homo Sapiens
uccauugcacuccagucugggc

SEQ ID NO: 2351 - RNA, 22 nt, Homo Sapiens
uccagggugggccucagacccu

SEQ ID NO: 2352 - RNA, 22 nt, Homo Sapiens
ugaugcuugagcacaguaccuc

SEQ ID NO: 2353 - RNA, 22 nt, Homo Sapiens
ugaguuuaagcuaagaagucug

SEQ ID NO: 2354 - RNA, 22 nt, Homo Sapiens
ugcaugcucuucaugagaaucu

SEQ ID NO: 2355 - RNA, 22 nt, Homo Sapiens
ugacaagauacaggguagugaa

SEQ ID NO: 2356 - RNA, 22 nt, Homo Sapiens
ggcagugucauuagcugauugu

SEQ ID NO: 2357 - RNA, 22 nt, Homo Sapiens
ggcaugauggagaggguggaga

SEQ ID NO: 2358 - RNA, 22 nt, Homo Sapiens
ggaaaacaaguaccccuggaac

SEQ ID NO: 2359 - RNA, 22 nt, Homo Sapiens
gcugcuccugcucucccucucc

SEQ ID NO: 2360 - RNA, 22 nt, Homo Sapiens
ggaggaggaggcuggugcuggu

SEQ ID NO: 2361 - RNA, 22 nt, Homo Sapiens
uacaguucugguuucuucuuua

SEQ ID NO: 2362 - RNA, 22 nt, Homo Sapiens
uaacuggccuuggaaccuguag

SEQ ID NO: 2363 - RNA, 22 nt, Homo Sapiens
uagcagcaggagcagguaacau

SEQ ID NO: 2364 - RNA, 22 nt, Homo Sapiens
uaugagugugaugguguuugag

SEQ ID NO: 2365 - RNA, 22 nt, Homo Sapiens
uaucucuugccuugaccuccua

SEQ ID NO: 2366 - RNA, 22 nt, Homo Sapiens
uauuggguuuaaagucaccguu

SEQ ID NO: 2367 - RNA, 22 nt, Homo Sapiens
gguucucaaaugagggacauuu

SEQ ID NO: 2368 - RNA, 22 nt, Homo Sapiens
gugcuuccauuuccccaucugu

SEQ ID NO: 2369 - RNA, 22 nt, Homo Sapiens
guucugcugagauacgugcucu

SEQ ID NO: 2370 - RNA, 22 nt, Homo Sapiens
guuacagcucucaaagaagaca

SEQ ID NO: 2371 - RNA, 22 nt, Homo Sapiens
uuguuuuagaagaaggucagaa

SEQ ID NO: 2372 - RNA, 22 nt, Homo Sapiens
uuggugcaaauggcauuuccau

SEQ ID NO: 2373 - RNA, 22 nt, Homo Sapiens
uuccuucagcccuagcugcuuu

SEQ ID NO: 2374 - RNA, 22 nt, Homo Sapiens
gugaggcaggaaccccaaagcc

SEQ ID NO: 2375 - RNA, 22 nt, Homo Sapiens
ggugcagaucauggauagagcu

SEQ ID NO: 2376 - RNA, 22 nt, Homo Sapiens
gccauugcacuccagccugggc

SEQ ID NO: 2377 - RNA, 22 nt, Homo Sapiens
gggccaugacagggagauaggc

SEQ ID NO: 2378 - RNA, 22 nt, Homo Sapiens
ugaguauucaccaggugcuggg

SEQ ID NO: 2379 - RNA, 22 nt, Homo Sapiens
ucacuugccuagggucacacag

SEQ ID NO: 2380 - RNA, 22 nt, Homo Sapiens
ucuuugcuggaaggugccuccc

SEQ ID NO: 2381 - RNA, 21 nt, Homo Sapiens
ucugcugugauggacacuugu

SEQ ID NO: 2382 - RNA, 22 nt, Homo Sapiens
ucugcugugauggacacuugua

SEQ ID NO: 2383 - RNA, 22 nt, Homo Sapiens
ucugccucccugucucacucuc

SEQ ID NO: 2384 - RNA, 22 nt, Homo Sapiens
uggagagauagugauuuagcuc

SEQ ID NO: 2385 - RNA, 22 nt, Homo Sapiens
uggcucugugcuucuaguaucu

SEQ ID NO: 2386 - RNA, 22 nt, Homo Sapiens
uggcucaguuugcucagcagug

SEQ ID NO: 2387 - RNA, 22 nt, Homo Sapiens
caucucagucuauguccuugcu

SEQ ID NO: 2388 - RNA, 22 nt, Homo Sapiens
cagaaucuuuugucucugagaa

SEQ ID NO: 2389 - RNA, 22 nt, Homo Sapiens
cuggcucccucucuucucuccc

SEQ ID NO: 2390 - RNA, 22 nt, Homo Sapiens
cuucaaugcuugagaagucgua

SEQ ID NO: 2391 - RNA, 22 nt, Homo Sapiens
acugcagcuucagggacuugug

SEQ ID NO: 2392 - RNA, 22 nt, Homo Sapiens
agaaugaaaggcaguuccuagc

SEQ ID NO: 2393 - RNA, 22 nt, Homo Sapiens
acaguguuacccaggcuggucu

SEQ ID NO: 2394 - RNA, 22 nt, Homo Sapiens
agugauuuuccugccucagccu

SEQ ID NO: 2395 - RNA, 22 nt, Homo Sapiens
agcagcgcagguagauggggcu

SEQ ID NO: 2396 - RNA, 22 nt, Homo Sapiens
cuggaagacaugguagagcuga

SEQ ID NO: 2397 - RNA, 22 nt, Homo Sapiens
gaggcgggaagcccacuaggag

SEQ ID NO: 2398 - RNA, 22 nt, Homo Sapiens
ucugccucccugucucacucuc

SEQ ID NO: 2399 - RNA, 22 nt, Homo Sapiens
ugcaccacuacacuccuaggca

SEQ ID NO: 2400 - RNA, 22 nt, Homo Sapiens
ugccuaggcaggacggaaugca

SEQ ID NO: 2401 - RNA, 22 nt, Homo Sapiens
guuuggcacugaaucauauaca

SEQ ID NO: 2402 - RNA, 22 nt, Homo Sapiens
uauuuguuuuuaaugcugggug

SEQ ID NO: 2403 - RNA, 22 nt, Homo Sapiens
uacaaauuccugggucuccugg

SEQ ID NO: 2404 - RNA, 22 nt, Homo Sapiens
ggugaugcauuuaaaagggcag

SEQ ID NO: 2405 - RNA, 22 nt, Homo Sapiens
gcacacaccuccuugcaguggc

SEQ ID NO: 2406 - RNA, 22 nt, Homo Sapiens
ucugccucccugucucacucuc

SEQ ID NO: 2407 - RNA, 22 nt, Homo Sapiens
ucccugggacaacuuucuuauu

SEQ ID NO: 2408 - RNA, 22 nt, Homo Sapiens
uggcucaguuugcucagcagug

SEQ ID NO: 2409 - RNA, 22 nt, Homo Sapiens
ugcuaggcuuauucucuuccuc

SEQ ID NO: 2410 - RNA, 21 nt, Homo Sapiens
gacacaggcccagagaggcag

SEQ ID NO: 2411 - RNA, 22 nt, Homo Sapiens
agcuccaggagcuggcaggagg

SEQ ID NO: 2412 - RNA, 22 nt, Homo Sapiens
agauggagaaguguuuucagau

SEQ ID NO: 2413 - RNA, 22 nt, Homo Sapiens
auuagcuauagcaaaaggcuua

SEQ ID NO: 2414 - RNA, 22 nt, Homo Sapiens
acacaggcccagagaggcagug

SEQ ID NO: 2415 - RNA, 22 nt, Homo Sapiens
aaguuuuuuuaaauuagcuagg

SEQ ID NO: 2416 - RNA, 22 nt, Homo Sapiens
cugggcgugugaggcggcugug

SEQ ID NO: 2417 - RNA, 22 nt, Homo Sapiens
cuagacugaagcuuuaugagga

SEQ ID NO: 2418 - RNA, 22 nt, Homo Sapiens
ccugggggccacuuugcacagg

SEQ ID NO: 2419 - RNA, 22 nt, Homo Sapiens
gcagcaggcagggccaggcagg

SEQ ID NO: 2420 - RNA, 22 nt, Homo Sapiens
gcaggaugguuggacugaaggg

SEQ ID NO: 2421 - RNA, 22 nt, Homo Sapiens
ggccaggacucuugcagaacug

SEQ ID NO: 2422 - RNA, 22 nt, Homo Sapiens
uuuggauuccugguuccuacag

SEQ ID NO: 2423 - RNA, 22 nt, Homo Sapiens
uuugcagcuuccaaauuucuga

SEQ ID NO: 2424 - RNA, 22 nt, Homo Sapiens
ggccugaggucagcaguagagg

SEQ ID NO: 2425 - RNA, 22 nt, Homo Sapiens
gguccacaaggggagagcaggg

SEQ ID NO: 2426 - RNA, 22 nt, Homo Sapiens
ggcaugauggagaggguggaga

SEQ ID NO: 2427 - RNA, 22 nt, Homo Sapiens
ggcaggauggagcagggcuaaa

SEQ ID NO: 2428 - RNA, 22 nt, Homo Sapiens
uggaauggcugaagacugugaa

SEQ ID NO: 2429 - RNA, 22 nt, Homo Sapiens
ugccuaggcaggacggaaugca

SEQ ID NO: 2430 - RNA, 22 nt, Homo Sapiens
ugaggcaggaguuggcaagagg

SEQ ID NO: 2431 - RNA, 22 nt, Homo Sapiens
ccagccugagguuccuggaggg

SEQ ID NO: 2432 - RNA, 22 nt, Homo Sapiens
auuuuucugcauuuguauugga

SEQ ID NO: 2433 - RNA, 22 nt, Homo Sapiens
cuggcugcauuuaggaacaagg

SEQ ID NO: 2434 - RNA, 22 nt, Homo Sapiens
cugaggcaggagggcucaggag

SEQ ID NO: 2435 - RNA, 22 nt, Homo Sapiens
gagagugcuuuggguguaggcc

SEQ ID NO: 2436 - RNA, 22 nt, Homo Sapiens
acacaggcccagagaggcagug

SEQ ID NO: 2437 - RNA, 22 nt, Homo Sapiens
aauggcagucccuggagcagga

SEQ ID NO: 2438 - RNA, 22 nt, Homo Sapiens
agaagguuggggcuggaggucu

SEQ ID NO: 2439 - RNA, 22 nt, Homo Sapiens
aggcugagugacugggaguuag

SEQ ID NO: 2440 - RNA, 22 nt, Homo Sapiens
agaagguuggggcuggaggucu

SEQ ID NO: 2441 - RNA, 22 nt, Homo Sapiens
aaaguggcuggaguggagucuu

SEQ ID NO: 2442 - RNA, 22 nt, Homo Sapiens
aaccugcugguaaagcacuggc

SEQ ID NO: 2443 - RNA, 22 nt, Homo Sapiens
gagauccuuucacaguuguggu

SEQ ID NO: 2444 - RNA, 22 nt, Homo Sapiens
gagaugacugguggcugggggc

SEQ ID NO: 2445 - RNA, 22 nt, Homo Sapiens
cuggcucccucucuucucuccc

SEQ ID NO: 2446 - RNA, 22 nt, Homo Sapiens
ugacuggaggaagggagguaag

SEQ ID NO: 2447 - RNA, 22 nt, Homo Sapiens
ucuuugaucucuuccggggcuu

SEQ ID NO: 2448 - RNA, 22 nt, Homo Sapiens
uggagcagaaaggcaggagucc

SEQ ID NO: 2449 - RNA, 22 nt, Homo Sapiens
uggauuaguaaagaagaaugaa

SEQ ID NO: 2450 - RNA, 22 nt, Homo Sapiens
uuaaugcuaaucgugauagggg

SEQ ID NO: 2451 - RNA, 22 nt, Homo Sapiens
ggccaggacucuugcagaacug

SEQ ID NO: 2452 - RNA, 22 nt, Homo Sapiens
ggaggaggaggcuggugcuggu

SEQ ID NO: 2453 - RNA, 22 nt, Homo Sapiens
ucacaguugagagaagguucug

SEQ ID NO: 2454 - RNA, 22 nt, Homo Sapiens
ucacauccucccacuucaagug

SEQ ID NO: 2455 - RNA, 22 nt, Homo Sapiens
gugucacagauggccggaagag

SEQ ID NO: 2456 - RNA, 22 nt, Homo Sapiens
gugaagguagguuucagguuug

SEQ ID NO: 2457 - RNA, 22 nt, Homo Sapiens
uagcaccuucugaaauaacgug

SEQ ID NO: 2458 - RNA, 22 nt, Homo Sapiens
ggcagcugugcagagugggggu

SEQ ID NO: 2459 - RNA, 22 nt, Homo Sapiens
uuaguguucaggcucaaaugaa

SEQ ID NO: 2460 - RNA, 22 nt, Homo Sapiens
ugagggcaggugugaaaaugcu

SEQ ID NO: 2461 - RNA, 22 nt, Homo Sapiens
cuggucccugugucagucuuaa

SEQ ID NO: 2462 - RNA, 22 nt, Homo Sapiens
gaggugaaggaacaaaugcuga

SEQ ID NO: 2463 - RNA, 22 nt, Homo Sapiens
gauuccuccucuuuaaaauggu

SEQ ID NO: 2464 - RNA, 22 nt, Homo Sapiens
cacaauauagcaaauagagggu

SEQ ID NO: 2465 - RNA, 22 nt, Homo Sapiens
aagagcugaguaauugggggca

SEQ ID NO: 2466 - RNA, 22 nt, Homo Sapiens
aagguagauaaaggcuucacgu

SEQ ID NO: 2467 - RNA, 22 nt, Homo Sapiens
agucagacguuuggcaacagca

SEQ ID NO: 2468 - RNA, 22 nt, Homo Sapiens
agugguuucagggacuucugua

SEQ ID NO: 2469 - RNA, 22 nt, Homo Sapiens
uugaucacagcuacuuuugucc

SEQ ID NO: 2470 - RNA, 22 nt, Homo Sapiens
uugucagaggcugguagggugu

SEQ ID NO: 2471 - RNA, 22 nt, Homo Sapiens
cagaaaguagaaagcagauucg

SEQ ID NO: 2472 - RNA, 22 nt, Homo Sapiens
ugagugacagagcaacacucug

SEQ ID NO: 2473 - RNA, 22 nt, Homo Sapiens
ugaguguaugugugagagagaa

SEQ ID NO: 2474 - RNA, 22 nt, Homo Sapiens
ucugucauuuuucucuuuccau

SEQ ID NO: 2475 - RNA, 22 nt, Homo Sapiens
uggcucaguuugcucagcagug

SEQ ID NO: 2476 - RNA, 22 nt, Homo Sapiens
ugcuaggcuuauucucuuccuc

SEQ ID NO: 2477 - RNA, 22 nt, Homo Sapiens
ggaagaaugugcuuuuguuguu

SEQ ID NO: 2478 - RNA, 22 nt, Homo Sapiens
ggccucagaagcugaggggaga

SEQ ID NO: 2479 - RNA, 22 nt, Homo Sapiens
gggccaugacagggagauaggc

SEQ ID NO: 2480 - RNA, 22 nt, Homo Sapiens
uacagcucugcuucuggcucac

SEQ ID NO: 2481 - RNA, 22 nt, Homo Sapiens
ugaggacagaaaguuugugcug

SEQ ID NO: 2482 - RNA, 22 nt, Homo Sapiens
cuuggcccugugaggcuucacc

SEQ ID NO: 2483 - RNA, 22 nt, Homo Sapiens
cugggcgugugaggcggcugug

SEQ ID NO: 2484 - RNA, 22 nt, Homo Sapiens
acacaggcccagagaggcagug

SEQ ID NO: 2485 - RNA, 22 nt, Homo Sapiens
uugccuaggccggagugcagug

SEQ ID NO: 2486 - RNA, 22 nt, Homo Sapiens
accuggccuguaggcaagucuu

SEQ ID NO: 2487 - RNA, 22 nt, Homo Sapiens
gaggagguggggcagcagcagg

SEQ ID NO: 2488 - RNA, 22 nt, Homo Sapiens
ugccuaggcaggacggaaugca

SEQ ID NO: 2489 - RNA, 22 nt, Homo Sapiens
uacaggcaggcacagaggcagu

SEQ ID NO: 2490 - RNA, 22 nt, Homo Sapiens
gcaggcugguuggugaggcaaa

SEQ ID NO: 2491 - RNA, 22 nt, Homo Sapiens
gcagcaggcagggccaggcagg

SEQ ID NO: 2492 - RNA, 22 nt, Homo Sapiens
ugucaguuuuuuaaauacucag

SEQ ID NO: 2493 - RNA, 22 nt, Homo Sapiens
auauuggugaaaugcuagcaaa

SEQ ID NO: 2494 - RNA, 22 nt, Homo Sapiens
agucagacguuuggcaacagca

SEQ ID NO: 2495 - RNA, 22 nt, Homo Sapiens
aguccaguguucucugcucugu

SEQ ID NO: 2496 - RNA, 22 nt, Homo Sapiens
aggcagaaaacaauuccaagca

SEQ ID NO: 2497 - RNA, 22 nt, Homo Sapiens
acugcacucuagccuaggugau

SEQ ID NO: 2498 - RNA, 22 nt, Homo Sapiens
aauuuaacagacagccacagcc

SEQ ID NO: 2499 - RNA, 22 nt, Homo Sapiens
gaggugaaggaacaaaugcuga

SEQ ID NO: 2500 - RNA, 22 nt, Homo Sapiens
cuggcucccucucuucucuccc

SEQ ID NO: 2501 - RNA, 22 nt, Homo Sapiens
cucugccucccgggucuaggcu

SEQ ID NO: 2502 - RNA, 22 nt, Homo Sapiens
cacugcaacccccgccucccag

SEQ ID NO: 2503 - RNA, 22 nt, Homo Sapiens
ccugcccauccugccuccacca

SEQ ID NO: 2504 - RNA, 22 nt, Homo Sapiens
uguaaacaucccacacacucag

SEQ ID NO: 2505 - RNA, 22 nt, Homo Sapiens
uuacaaaauuuggagggauugu

SEQ ID NO: 2506 - RNA, 22 nt, Homo Sapiens
uucaguucuugaccugccccag

SEQ ID NO: 2507 - RNA, 22 nt, Homo Sapiens
ucugccucccugucucacucuc

SEQ ID NO: 2508 - RNA, 22 nt, Homo Sapiens
ucugagcccaggaguuugaggc

SEQ ID NO: 2509 - RNA, 22 nt, Homo Sapiens
uccaguacaggucucucauuuc

SEQ ID NO: 2510 - RNA, 22 nt, Homo Sapiens
uccccaagccuuguaccagcgu

SEQ ID NO: 2511 - RNA, 22 nt, Homo Sapiens
gggaggauccuugcucaacuua

SEQ ID NO: 2512 - RNA, 22 nt, Homo Sapiens
ggccaggacucuugcagaacug

SEQ ID NO: 2513 - RNA, 22 nt, Homo Sapiens
uacaggcaggcacagaggcagu

SEQ ID NO: 2514 - RNA, 22 nt, Homo Sapiens
ggugacagagacucugccucga

SEQ ID NO: 2515 - RNA, 22 nt, Homo Sapiens
uucucccugcccacacauccag

SEQ ID NO: 2516 - RNA, 22 nt, Homo Sapiens
uugcucaggcuggagugcagug

SEQ ID NO: 2517 - RNA, 22 nt, Homo Sapiens
uugcccaggcuggagugcagug

SEQ ID NO: 2518 - RNA, 22 nt, Homo Sapiens
uugcccaggcuagagugcagug

SEQ ID NO: 2519 - RNA, 22 nt, Homo Sapiens
gugugggcagggccgugcuccc

SEQ ID NO: 2520 - RNA, 22 nt, Homo Sapiens
uacaggcaggcacagaggcagu

SEQ ID NO: 2521 - RNA, 22 nt, Homo Sapiens
uagacugaggcuuccugcaggg

SEQ ID NO: 2522 - RNA, 22 nt, Homo Sapiens
gggccaugacagggagauaggc

SEQ ID NO: 2523 - RNA, 22 nt, Homo Sapiens
gcagcaggcagggccaggcagg

SEQ ID NO: 2524 - RNA, 22 nt, Homo Sapiens
gcacacaccuccuugcaguggc

SEQ ID NO: 2525 - RNA, 22 nt, Homo Sapiens
gcugcuccugcucucccucucc

SEQ ID NO: 2526 - RNA, 22 nt, Homo Sapiens
ucccuuugaagccagguuccag

SEQ ID NO: 2527 - RNA, 22 nt, Homo Sapiens
uccucaucuuugagucccagcg

SEQ ID NO: 2528 - RNA, 22 nt, Homo Sapiens
ucagucguuucucucucccagc

SEQ ID NO: 2529 - RNA, 22 nt, Homo Sapiens
ucuuccauuccccuccuacgcc

SEQ ID NO: 2530 - RNA, 22 nt, Homo Sapiens
ucuuccccaccuucggcuugca

SEQ ID NO: 2531 - RNA, 22 nt, Homo Sapiens
ugauccucuggcuucagccucc

SEQ ID NO: 2532 - RNA, 22 nt, Homo Sapiens
ugaucacaggcaaaggaauaaa

SEQ ID NO: 2533 - RNA, 22 nt, Homo Sapiens
ugaggcaggaguuggcaagagg

SEQ ID NO: 2534 - RNA, 22 nt, Homo Sapiens
uuaccauguuggccaggcuggu

SEQ ID NO: 2535 - RNA, 22 nt, Homo Sapiens
uggagcagaaaggcaggagucc

SEQ ID NO: 2536 - RNA, 22 nt, Homo Sapiens
uggagagauagugauuuagcuc

SEQ ID NO: 2537 - RNA, 22 nt, Homo Sapiens
uggagugucuggaggugucucu

SEQ ID NO: 2538 - RNA, 22 nt, Homo Sapiens
ugguggggagaggcuugggaag

SEQ ID NO: 2539 - RNA, 22 nt, Homo Sapiens
ccugcccauccugccuccacca

SEQ ID NO: 2540 - RNA, 22 nt, Homo Sapiens
cccaggcuggagugcaguggug

SEQ ID NO: 2541 - RNA, 22 nt, Homo Sapiens
cgcuauguuggccaggcugguc

SEQ ID NO: 2542 - RNA, 22 nt, Homo Sapiens
ccagccugagguuccuggaggg

SEQ ID NO: 2543 - RNA, 22 nt, Homo Sapiens
ccaaagugcuaggauuacagcc

SEQ ID NO: 2544 - RNA, 22 nt, Homo Sapiens
ccaaagugcugggauuacaggc

SEQ ID NO: 2545 - RNA, 22 nt, Homo Sapiens
ccaaagugcuaggaauacaggu

SEQ ID NO: 2546 - RNA, 22 nt, Homo Sapiens
ccaaagugcuggcguuacaggu

SEQ ID NO: 2547 - RNA, 22 nt, Homo Sapiens
caaagugcugagauuacaggca

SEQ ID NO: 2548 - RNA, 22 nt, Homo Sapiens
cacccaggcuggagugcagugg

SEQ ID NO: 2549 - RNA, 22 nt, Homo Sapiens
cacugggauuacagaugugagc

SEQ ID NO: 2550 - RNA, 22 nt, Homo Sapiens
cucugccucccgggucuaggcu

SEQ ID NO: 2551 - RNA, 22 nt, Homo Sapiens
cugaggcaggagggcucaggag

SEQ ID NO: 2552 - RNA, 22 nt, Homo Sapiens
cugggauuacaggugugaacca

SEQ ID NO: 2553 - RNA, 22 nt, Homo Sapiens
cugugccugugacgagggauga

SEQ ID NO: 2554 - RNA, 22 nt, Homo Sapiens
gauuccuccucuuuaaaauggu

SEQ ID NO: 2555 - RNA, 22 nt, Homo Sapiens
gagauggaguuuuacuauguug

SEQ ID NO: 2556 - RNA, 22 nt, Homo Sapiens
gaccccuugcccguggcuccca

SEQ ID NO: 2557 - RNA, 22 nt, Homo Sapiens
gaaccuucaacugcuuagccug

SEQ ID NO: 2558 - RNA, 22 nt, Homo Sapiens
aagugcugggauuacaggccug

SEQ ID NO: 2559 - RNA, 22 nt, Homo Sapiens
acaguguuacccaggcuggucu

SEQ ID NO: 2560 - RNA, 22 nt, Homo Sapiens
agacuggccucaagcucccaga

SEQ ID NO: 2561 - RNA, 22 nt, Homo Sapiens
aaugcugugccagagcugcacc

SEQ ID NO: 2562 - RNA, 22 nt, Homo Sapiens
gacaagaggcacagacagcagg

SEQ ID NO: 2563 - RNA, 22 nt, Homo Sapiens
cuggcucccucucuucucuccc

SEQ ID NO: 2564 - RNA, 22 nt, Homo Sapiens
uucaggcaccaggcacuuugcc

SEQ ID NO: 2565 - RNA, 22 nt, Homo Sapiens
ucugguuugagagacaaugaca

SEQ ID NO: 2566 - RNA, 22 nt, Homo Sapiens
ggcaugauucagcagaggagag

SEQ ID NO: 2567 - RNA, 22 nt, Homo Sapiens
gguccagacuggaguauagugc

SEQ ID NO: 2568 - RNA, 22 nt, Homo Sapiens
ucaaagcugcagauugccugug

SEQ ID NO: 2569 - RNA, 22 nt, Homo Sapiens
gguccacaaggggagagcaggg

SEQ ID NO: 2570 - RNA, 22 nt, Homo Sapiens
ggcugggcaugguggcucacgc

SEQ ID NO: 2571 - RNA, 22 nt, Homo Sapiens
ugagagaggaaggccguaggga

SEQ ID NO: 2572 - RNA, 22 nt, Homo Sapiens
uguccuuuguuuugagauggag

SEQ ID NO: 2573 - RNA, 22 nt, Homo Sapiens
ugguggggagaggcuugggaag

SEQ ID NO: 2574 - RNA, 22 nt, Homo Sapiens
uggguuagugguugaauaguuu

SEQ ID NO: 2575 - RNA, 22 nt, Homo Sapiens
uggagagauaagccaaguaucc

SEQ ID NO: 2576 - RNA, 22 nt, Homo Sapiens
uggagagagcagguugcuaaga

SEQ ID NO: 2577 - RNA, 22 nt, Homo Sapiens
uggaaugaggaagggugugguc

SEQ ID NO: 2578 - RNA, 22 nt, Homo Sapiens
cugggcucuggucuguagguuu

SEQ ID NO: 2579 - RNA, 22 nt, Homo Sapiens
gacaagaggcacagacagcagg

SEQ ID NO: 2580 - RNA, 22 nt, Homo Sapiens
gagguagagguugcagugaguc

SEQ ID NO: 2581 - RNA, 22 nt, Homo Sapiens
ccuuguguuuuccagauucuga

SEQ ID NO: 2582 - RNA, 22 nt, Homo Sapiens
acugcacuccauccuggggagc

SEQ ID NO: 2583 - RNA, 22 nt, Homo Sapiens
augggcaaauacugggagcugg

SEQ ID NO: 2584 - RNA, 22 nt, Homo Sapiens
aucugcugucuuuuagaagugg

SEQ ID NO: 2585 - RNA, 22 nt, Homo Sapiens
uucuacuagugguugauggccu

SEQ ID NO: 2586 - RNA, 22 nt, Homo Sapiens
uucugugcagguuaacauuucu

SEQ ID NO: 2587 - RNA, 22 nt, Homo Sapiens
uugcacuccagccugggugaca

SEQ ID NO: 2588 - RNA, 22 nt, Homo Sapiens
uugcacuccagucugggugaca

SEQ ID NO: 2589 - RNA, 22 nt, Homo Sapiens
auugcacuccagccugggugac

SEQ ID NO: 2590 - RNA, 22 nt, Homo Sapiens
auugcacuucagccugggugac

SEQ ID NO: 2591 - RNA, 22 nt, Homo Sapiens
acugcacuccugccugggugac

SEQ ID NO: 2592 - RNA, 22 nt, Homo Sapiens
ccccagucaaugcuucucucca

SEQ ID NO: 2593 - RNA, 22 nt, Homo Sapiens
cauugcacuccagccuggguga

SEQ ID NO: 2594 - RNA, 22 nt, Homo Sapiens
cagcaguguugcgaaucaucac

SEQ ID NO: 2595 - RNA, 22 nt, Homo Sapiens
cuggguggccuucaguccauga

SEQ ID NO: 2596 - RNA, 22 nt, Homo Sapiens
uggagcagaaaggcaggagucc

SEQ ID NO: 2597 - RNA, 22 nt, Homo Sapiens
ugcagccuugaacucuuucugg

SEQ ID NO: 2598 - RNA, 22 nt, Homo Sapiens
ucugccucccugucucacucuc

SEQ ID NO: 2599 - RNA, 22 nt, Homo Sapiens
uccaguacaggucucucauuuc

SEQ ID NO: 2600 - RNA, 22 nt, Homo Sapiens
uccagugaaacaggucucuuug

SEQ ID NO: 2601 - RNA, 22 nt, Homo Sapiens
guucugcugagauacgugcucu

SEQ ID NO: 2602 - RNA, 22 nt, Homo Sapiens
ggugaugcauuuaaaagggcag

SEQ ID NO: 2603 - RNA, 22 nt, Homo Sapiens
ggcaugauggagaggguggaga

SEQ ID NO: 2604 - RNA, 22 nt, Homo Sapiens
ucugcugugauggacacuugua

SEQ ID NO: 2605 - RNA, 21 nt, Homo Sapiens
ucugcugugauggacacuugu

SEQ ID NO: 2606 - RNA, 22 nt, Homo Sapiens
ucugucauuuuucucuuuccau

SEQ ID NO: 2607 - RNA, 22 nt, Homo Sapiens
uggagccuuguuguuuguucac

SEQ ID NO: 2608 - RNA, 22 nt, Homo Sapiens
uggagaccugugugguuugugg

SEQ ID NO: 2609 - RNA, 22 nt, Homo Sapiens
uguguuugaacaccuuggucac

SEQ ID NO: 2610 - RNA, 22 nt, Homo Sapiens
uuaaugcuuuuugucauacuca

SEQ ID NO: 2611 - RNA, 22 nt, Homo Sapiens
cugugcccagccagggcugugu

SEQ ID NO: 2612 - RNA, 22 nt, Homo Sapiens
gagguagagguugcagugaguc

SEQ ID NO: 2613 - RNA, 22 nt, Homo Sapiens
gaccagccauccugguuuacau

SEQ ID NO: 2614 - RNA, 22 nt, Homo Sapiens
cuauuggauuuuaagcauuggg

SEQ ID NO: 2615 - RNA, 22 nt, Homo Sapiens
aucuagagaggcagucuggcca

SEQ ID NO: 2616 - RNA, 22 nt, Homo Sapiens
auggauauuuuugaugcccaga

SEQ ID NO: 2617 - RNA, 22 nt, Homo Sapiens
agugcuuugauuaugagaaagu

SEQ ID NO: 2618 - RNA, 22 nt, Homo Sapiens
uucuuuuuccgcuuucugagcc

SEQ ID NO: 2619 - RNA, 22 nt, Homo Sapiens
uucccucauucuccacccaguc

SEQ ID NO: 2620 - RNA, 22 nt, Homo Sapiens
uuuggcuguuugucuugggcaa

SEQ ID NO: 2621 - RNA, 22 nt, Homo Sapiens
uugcaauagugaaaaaacugaa

SEQ ID NO: 2622 - RNA, 22 nt, Homo Sapiens
uuugaugcaugugaccugggau

SEQ ID NO: 2623 - RNA, 22 nt, Homo Sapiens
auggccuuuucucuuauccugg

SEQ ID NO: 2624 - RNA, 22 nt, Homo Sapiens
agauaguucucuguuguugggg

SEQ ID NO: 2625 - RNA, 22 nt, Homo Sapiens
aaguggcuuuugucuggcagau

SEQ ID NO: 2626 - RNA, 22 nt, Homo Sapiens
acagcucacuacagccuggauu

SEQ ID NO: 2627 - RNA, 22 nt, Homo Sapiens
cagguacuuuuugguuuacaug

SEQ ID NO: 2628 - RNA, 22 nt, Homo Sapiens
cagagaauggcacagcuguccu

SEQ ID NO: 2629 - RNA, 22 nt, Homo Sapiens
auuuuucugcauuuguauugga

SEQ ID NO: 2630 - RNA, 22 nt, Homo Sapiens
gaacagcuccagucuacagccc

SEQ ID NO: 2631 - RNA, 22 nt, Homo Sapiens
cucuuuaguaggaacucuggau

SEQ ID NO: 2632 - RNA, 22 nt, Homo Sapiens
uuagggcaggcaugagagaacu

SEQ ID NO: 2633 - RNA, 22 nt, Homo Sapiens
uggagugucuggaggugucucu

SEQ ID NO: 2634 - RNA, 22 nt, Homo Sapiens
ggcaugauggagaggguggaga

SEQ ID NO: 2635 - RNA, 22 nt, Homo Sapiens
gcagcuguuuauuuagaaccug

SEQ ID NO: 2636 - RNA, 22 nt, Homo Sapiens
gugcuuccauuuccccaucugu

SEQ ID NO: 2637 - RNA, 22 nt, Homo Sapiens
uacgcugugcugugacauggua

SEQ ID NO: 2638 - RNA, 22 nt, Homo Sapiens
gcagcaggcagggccaggcagg

SEQ ID NO: 2639 - RNA, 22 nt, Homo Sapiens
gcugagaccacccuugccugcc

SEQ ID NO: 2640 - RNA, 22 nt, Homo Sapiens
ggcaugauucagcagaggagag

SEQ ID NO: 2641 - RNA, 22 nt, Homo Sapiens
ggcaugugugagcagcugcagg

SEQ ID NO: 2642 - RNA, 22 nt, Homo Sapiens
ggccccuuugugaggcacgcuu

SEQ ID NO: 2643 - RNA, 22 nt, Homo Sapiens
gguccacaaggggagagcaggg

SEQ ID NO: 2644 - RNA, 22 nt, Homo Sapiens
ggccugaggucagcaguagagg

SEQ ID NO: 2645 - RNA, 22 nt, Homo Sapiens
ugguccagaggaggaaugaggg

SEQ ID NO: 2646 - RNA, 22 nt, Homo Sapiens
uggcaaggugugggcuagagau

SEQ ID NO: 2647 - RNA, 22 nt, Homo Sapiens
uggcagauuugguugcuguugg

SEQ ID NO: 2648 - RNA, 22 nt, Homo Sapiens
uucaggcaccaggcacuuugcc

SEQ ID NO: 2649 - RNA, 22 nt, Homo Sapiens
uucaggacuguggacugggcug

SEQ ID NO: 2650 - RNA, 22 nt, Homo Sapiens
uucacauguugcucaguuuugc

SEQ ID NO: 2651 - RNA, 22 nt, Homo Sapiens
uguacaaggggcucagccagcc

SEQ ID NO: 2652 - RNA, 22 nt, Homo Sapiens
ucaggcugaggucaucugcauc

SEQ ID NO: 2653 - RNA, 22 nt, Homo Sapiens
ugaggucauguucugucagguu

SEQ ID NO: 2654 - RNA, 22 nt, Homo Sapiens
cucugccucccgggucuaggcu

SEQ ID NO: 2655 - RNA, 22 nt, Homo Sapiens
cucagugguucagacacuguuu

SEQ ID NO: 2656 - RNA, 22 nt, Homo Sapiens
cugaauagaacagaagagcagc

SEQ ID NO: 2657 - RNA, 22 nt, Homo Sapiens
cugaggucaggaguucgagacc

SEQ ID NO: 2658 - RNA, 22 nt, Homo Sapiens
cugugcauguugauauccuggc

SEQ ID NO: 2659 - RNA, 22 nt, Homo Sapiens
cuuggcccugugaggcuucacc

SEQ ID NO: 2660 - RNA, 22 nt, Homo Sapiens
gagaugacugguggcugggggc

SEQ ID NO: 2661 - RNA, 22 nt, Homo Sapiens
gaggcagcaacuggugaggcac

SEQ ID NO: 2662 - RNA, 22 nt, Homo Sapiens
cguguaaucccagcuacuuggg

SEQ ID NO: 2663 - RNA, 22 nt, Homo Sapiens
ccuggcuuaggaagcucacaag

SEQ ID NO: 2664 - RNA, 22 nt, Homo Sapiens
cgacucuugaccauggcugggg

SEQ ID NO: 2665 - RNA, 22 nt, Homo Sapiens
ccccagucaaugcuucucucca

SEQ ID NO: 2666 - RNA, 22 nt, Homo Sapiens
ccagccugagguuccuggaggg

SEQ ID NO: 2667 - RNA, 22 nt, Homo Sapiens
aaggaagugucucuuggcuggc

SEQ ID NO: 2668 - RNA, 22 nt, Homo Sapiens
acaguccucuacuccagcuccc

SEQ ID NO: 2669 - RNA, 22 nt, Homo Sapiens
agagcuaggaagauacaggguu

SEQ ID NO: 2670 - RNA, 22 nt, Homo Sapiens
aggcaguaagggagaguuuugc

SEQ ID NO: 2671 - RNA, 22 nt, Homo Sapiens
aggccagagaggacucucuuuu

SEQ ID NO: 2672 - RNA, 22 nt, Homo Sapiens
agguagggaggguagaugcucu

SEQ ID NO: 2673 - RNA, 22 nt, Homo Sapiens
agugcagguucacaggcugggc

SEQ ID NO: 2674 - RNA, 22 nt, Homo Sapiens
auaagcacagggagguucuguc

SEQ ID NO: 2675 - RNA, 22 nt, Homo Sapiens
aggugggguuucaccauguugg

SEQ ID NO: 2676 - RNA, 22 nt, Homo Sapiens
uugguuggugaugagcauugaa

SEQ ID NO: 2677 - RNA, 22 nt, Homo Sapiens
cagcuauucaggagcuugaggu

SEQ ID NO: 2678 - RNA, 22 nt, Homo Sapiens
uucaccaaccacuccaccagcu

SEQ ID NO: 2679 - RNA, 21 nt, Homo Sapiens
uucacccaucuuuccacccac

SEQ ID NO: 2680 - RNA, 22 nt, Homo Sapiens
uucacccaucuuuccacccacg

SEQ ID NO: 2681 - RNA, 22 nt, Homo Sapiens
uguuaacauuuuggcuagauag

SEQ ID NO: 2682 - RNA, 22 nt, Homo Sapiens
uggggcacuguggaggugucau

SEQ ID NO: 2683 - RNA, 22 nt, Homo Sapiens
ggcagcugugcagagugggggu

SEQ ID NO: 2684 - RNA, 22 nt, Homo Sapiens
ucaaagcugcagauugccugug

SEQ ID NO: 2685 - RNA, 22 nt, Homo Sapiens
uaugaauguaaggaauguggga

SEQ ID NO: 2686 - RNA, 22 nt, Homo Sapiens
acagcaagucuuugucaaagcu

SEQ ID NO: 2687 - RNA, 22 nt, Homo Sapiens
aagugcuuugcuggaguccugu

SEQ ID NO: 2688 - RNA, 20 nt, Homo Sapiens
agcuccuucuuucugcaaca

SEQ ID NO: 2689 - RNA, 23 nt, Homo Sapiens
agugcuuugcuggaguccuguuc

SEQ ID NO: 2690 - RNA, 18 nt, Homo Sapiens
ccuguucucugagcucca

SEQ ID NO: 2691 - RNA, 21 nt, Homo Sapiens
cuccuccagcuccuucuuucu

SEQ ID NO: 2692 - RNA, 19 nt, Homo Sapiens
gcugaaaagugcuuugcug

SEQ ID NO: 2693 - RNA, 24 nt, Homo Sapiens
ggagaggggagagggacgcacagc

SEQ ID NO: 2694 - RNA, 17 nt, Homo Sapiens
ggagagggacgcacagc

SEQ ID NO: 2695 - RNA, 24 nt, Homo Sapiens
ggagagggacgcacagcacugccu

SEQ ID NO: 2696 - RNA, 26 nt, Homo Sapiens
gcccugaccucaggggccagggcacu

SEQ ID NO: 2697 - RNA, 25 nt, Homo Sapiens
gggagagggacgcacagcacugccu

SEQ ID NO: 2698 - RNA, 23 nt, Homo Sapiens
gggggagcugucugcggagccag

SEQ ID NO: 2699 - RNA, 27 nt, Homo Sapiens
gggggccuaaagcgacagucucagggg

SEQ ID NO: 2700 - RNA, 21 nt, Homo Sapiens
cucucaaggcccugaccucag

SEQ ID NO: 2701 - RNA, 28 nt, Homo Sapiens
cuccagggugccuccaccugcacaaccg

SEQ ID NO: 2702 - RNA, 28 nt, Homo Sapiens
ccuccagggugccuccaccugcacaacc

SEQ ID NO: 2703 - RNA, 27 nt, Homo Sapiens
ccucucaaggcccugaccucaggggcc

SEQ ID NO: 2704 - RNA, 27 nt, Homo Sapiens
cugggcccuguccagggcagugagucc

SEQ ID NO: 2705 - RNA, 20 nt, Homo Sapiens
cuuccagccaccugccucaa

SEQ ID NO: 2706 - RNA, 23 nt, Homo Sapiens
gaccucucaaggcccugaccuca

SEQ ID NO: 2707 - RNA, 18 nt, Homo Sapiens
gaugccauaaaagccgcc

SEQ ID NO: 2708 - RNA, 27 nt, Homo Sapiens
auccucucccccacaagagccccaaag

SEQ ID NO: 2709 - RNA, 22 nt, Homo Sapiens
auccuuccagccaccugccuca

SEQ ID NO: 2710 - RNA, 24 nt, Homo Sapiens
agggggagcugucugcggagccag

SEQ ID NO: 2711 - RNA, 26 nt, Homo Sapiens
auucguagccaucuccguggccaaug

SEQ ID NO: 2712 - RNA, 22 nt, Homo Sapiens
caauccuuccagccaccugccu

SEQ ID NO: 2713 - RNA, 23 nt, Homo Sapiens
caccauguucccagcucagugcc

SEQ ID NO: 2714 - RNA, 25 nt, Homo Sapiens
cagggcacugacaggacaggagagc

SEQ ID NO: 2715 - RNA, 26 nt, Homo Sapiens
ccagggcacugacaggacaggagagc

SEQ ID NO: 2716 - RNA, 24 nt, Homo Sapiens
cccagccucugagucccguggggc

SEQ ID NO: 2717 - RNA, 26 nt, Homo Sapiens
cccucgggccgggcaccacccccagu

SEQ ID NO: 2718 - RNA, 24 nt, Homo Sapiens
agagccccaaagaucccacgggag

SEQ ID NO: 2719 - RNA, 27 nt, Homo Sapiens
ucccuccagagacucgaguccccauga

SEQ ID NO: 2720 - RNA, 20 nt, Homo Sapiens
ugaggguggucagccaaggc

SEQ ID NO: 2721 - RNA, 23 nt, Homo Sapiens
ugggacccacagucacacagagc

SEQ ID NO: 2722 - RNA, 24 nt, Homo Sapiens
uguccagggcagugaguccucuac

SEQ ID NO: 2723 - RNA, 21 nt, Homo Sapiens
ugucaugucucugguggugcu

SEQ ID NO: 2724 - RNA, 20 nt, Homo Sapiens
ugggagccggaggcugcagu

SEQ ID NO: 2725 - RNA, 22 nt, Homo Sapiens
ugggagccggaggcugcaguga

SEQ ID NO: 2726 - RNA, 25 nt, Homo Sapiens
ugggccauuccaguacuuccugcag

SEQ ID NO: 2727 - RNA, 24 nt, Homo Sapiens
ugggaacacuggugggcagcugag

SEQ ID NO: 2728 - RNA, 23 nt, Homo Sapiens
uggagcucagcaacaaggcugca

SEQ ID NO: 2729 - RNA, 21 nt, Homo Sapiens
ugcugcugggccucugccuug

SEQ ID NO: 2730 - RNA, 19 nt, Homo Sapiens
ugcuucaguccacuucugc

SEQ ID NO: 2731 - RNA, 26 nt, Homo Sapiens
ugagccaagaucgcaccauugcacuc

SEQ ID NO: 2732 - RNA, 31 nt, Homo Sapiens
ugcaggcugcagucccuggaaaaacagucac

SEQ ID NO: 2733 - RNA, 22 nt, Homo Sapiens
ugcagugagccaagaucgcacc

SEQ ID NO: 2734 - RNA, 22 nt, Homo Sapiens
ucugacauuuauccaagaccug

SEQ ID NO: 2735 - RNA, 20 nt, Homo Sapiens
ucuucaugaccuacuucaaa

SEQ ID NO: 2736 - RNA, 20 nt, Homo Sapiens
ugagaaagagaaugagaaga

SEQ ID NO: 2737 - RNA, 25 nt, Homo Sapiens
uccaucaucuuccgcgcaggugcca

SEQ ID NO: 2738 - RNA, 25 nt, Homo Sapiens
ucauggccaccuccagggacaaaga

SEQ ID NO: 2739 - RNA, 23 nt, Homo Sapiens
uccuggagaacacguuggcucag

SEQ ID NO: 2740 - RNA, 21 nt, Homo Sapiens
uacugaccuggcuggugacag

SEQ ID NO: 2741 - RNA, 27 nt, Homo Sapiens
uucaaaccccuacugaccuggcuggug

SEQ ID NO: 2742 - RNA, 24 nt, Homo Sapiens
uucaccuccuuggcgcugccaccu

SEQ ID NO: 2743 - RNA, 24 nt, Homo Sapiens
uucugcagguacuuccucagucug

SEQ ID NO: 2744 - RNA, 26 nt, Homo Sapiens
uuggaagaggcugagacauucuucac

SEQ ID NO: 2745 - RNA, 21 nt, Homo Sapiens
uuguccugaugcugugcucaa

SEQ ID NO: 2746 - RNA, 22 nt, Homo Sapiens
agaggcugcugcagacaagugg

SEQ ID NO: 2747 - RNA, 27 nt, Homo Sapiens
agccuccuugucuauccuuccuccccc

SEQ ID NO: 2748 - RNA, 22 nt, Homo Sapiens
acacaccccacaccccagccca

SEQ ID NO: 2749 - RNA, 24 nt, Homo Sapiens
acacuggugggcagcugaggacac

SEQ ID NO: 2750 - RNA, 31 nt, Homo Sapiens
acauaggccugcucagccucuagcaccagga

SEQ ID NO: 2751 - RNA, 27 nt, Homo Sapiens
accagccuguccaacagaggggcagcc

SEQ ID NO: 2752 - RNA, 27 nt, Homo Sapiens
accauuguaaaguuuaugucaccagaa

SEQ ID NO: 2753 - RNA, 22 nt, Homo Sapiens
acugacucaagacacugagaua

SEQ ID NO: 2754 - RNA, 23 nt, Homo Sapiens
ccaucaucuuccgcgcaggugcc

SEQ ID NO: 2755 - RNA, 21 nt, Homo Sapiens
ccauugcacuccagcugggag

SEQ ID NO: 2756 - RNA, 27 nt, Homo Sapiens
ccauugcacuccagcugggagacacag

SEQ ID NO: 2757 - RNA, 18 nt, Homo Sapiens
cccacaagcaccugcuca

SEQ ID NO: 2758 - RNA, 21 nt, Homo Sapiens
cccagcccacccugcuccucc

SEQ ID NO: 2759 - RNA, 21 nt, Homo Sapiens
cauugcacuccagcugggaga

SEQ ID NO: 2760 - RNA, 24 nt, Homo Sapiens
cauugcacuccagcugggagacac

SEQ ID NO: 2761 - RNA, 27 nt, Homo Sapiens
cauugcacuccagcugggagacacagc

SEQ ID NO: 2762 - RNA, 22 nt, Homo Sapiens
ccaagaucgcaccauugcacuc

SEQ ID NO: 2763 - RNA, 27 nt, Homo Sapiens
cacuaggcacuguggcucugcaugaca

SEQ ID NO: 2764 - RNA, 21 nt, Homo Sapiens
caaucaggagugguggaaccu

SEQ ID NO: 2765 - RNA, 21 nt, Homo Sapiens
caccauugcacuccagcuggg

SEQ ID NO: 2766 - RNA, 21 nt, Homo Sapiens
auuccugagucugaagcugga

SEQ ID NO: 2767 - RNA, 20 nt, Homo Sapiens
aggccucugacauuuaucca

SEQ ID NO: 2768 - RNA, 22 nt, Homo Sapiens
aggcugaggcaggagaaucacu

SEQ ID NO: 2769 - RNA, 24 nt, Homo Sapiens
aggcuggccagacuucagcuguuc

SEQ ID NO: 2770 - RNA, 23 nt, Homo Sapiens
augaggucaauuuccugaugcau

SEQ ID NO: 2771 - RNA, 22 nt, Homo Sapiens
aucagccuggccaucuggauuu

SEQ ID NO: 2772 - RNA, 27 nt, Homo Sapiens
aucagccuggccaucuggauuuucaca

SEQ ID NO: 2773 - RNA, 27 nt, Homo Sapiens
gaugcucuaaagcugggcucaagcaag

SEQ ID NO: 2774 - RNA, 21 nt, Homo Sapiens
gcacaaaagggacuuggaaaa

SEQ ID NO: 2775 - RNA, 25 nt, Homo Sapiens
gcacacggcugccugacacugagcc

SEQ ID NO: 2776 - RNA, 22 nt, Homo Sapiens
gaccagccuguccaacagaggg

SEQ ID NO: 2777 - RNA, 24 nt, Homo Sapiens
gaaucacuggaaccugggagccgg

SEQ ID NO: 2778 - RNA, 22 nt, Homo Sapiens
cuuguccugaugcugugcucaa

SEQ ID NO: 2779 - RNA, 23 nt, Homo Sapiens
cugggagccggaggcugcaguga

SEQ ID NO: 2780 - RNA, 26 nt, Homo Sapiens
cugggagccggaggcugcagugagcc

SEQ ID NO: 2781 - RNA, 22 nt, Homo Sapiens
cugggcuuugucaugucucugg

SEQ ID NO: 2782 - RNA, 21 nt, Homo Sapiens
cugagccuccuugucuauccu

SEQ ID NO: 2783 - RNA, 21 nt, Homo Sapiens
ccgccagaucugcaccaccuu

SEQ ID NO: 2784 - RNA, 21 nt, Homo Sapiens
ccuacuucaaaccccuacuga

SEQ ID NO: 2785 - RNA, 27 nt, Homo Sapiens
cuccaucuuccacgaaaugggccauuc

SEQ ID NO: 2786 - RNA, 27 nt, Homo Sapiens
cuccuugucuauccuuccucccccacc

SEQ ID NO: 2787 - RNA, 26 nt, Homo Sapiens
cucuccaucuuccacgaaaugggcca

SEQ ID NO: 2788 - RNA, 25 nt, Homo Sapiens
cucugcucuccugcggccaugggcc

SEQ ID NO: 2789 - RNA, 22 nt, Homo Sapiens
cugaggcaggagaaucacugga

SEQ ID NO: 2790 - RNA, 19 nt, Homo Sapiens
gggagccggaggcugcagu

SEQ ID NO: 2791 - RNA, 22 nt, Homo Sapiens
gggagccggaggcugcagugag

SEQ ID NO: 2792 - RNA, 23 nt, Homo Sapiens
ggcuggccagacuucagcuguuc

SEQ ID NO: 2793 - RNA, 21 nt, Homo Sapiens
ggaugugaauggcaugcugaa

SEQ ID NO: 2794 - RNA, 23 nt, Homo Sapiens
ggcaggagaaucacuggaaccug

SEQ ID NO: 2795 - RNA, 22 nt, Homo Sapiens
ggcugcugcagacaaguggaca

SEQ ID NO: 2796 - RNA, 27 nt, Homo Sapiens
gggggcccaucccugcccaccuccugg

SEQ ID NO: 2797 - RNA, 21 nt, Homo Sapiens
gucaugucucugguggugcug

SEQ ID NO: 2798 - RNA, 27 nt, Homo Sapiens
gcccugucccugucccccuccccuccc

SEQ ID NO: 2799 - RNA, 22 nt, Homo Sapiens
gcccccacuaggcacuguggcu

SEQ ID NO: 2800 - RNA, 21 nt, Homo Sapiens
gcagugagccaagaucgcacc

SEQ ID NO: 2801 - RNA, 22 nt, Homo Sapiens
ggagcucagcaacaaggcugca

SEQ ID NO: 2802 - RNA, 22 nt, Homo Sapiens
ggaggcugaggcaggagaauca

SEQ ID NO: 2803 - RNA, 27 nt, Homo Sapiens
ggaggcugcagugagccaagaucgcac

SEQ ID NO: 2804 - RNA, 21 nt, Homo Sapiens
gcucuccaucuuccacgaaau

SEQ ID NO: 2805 - RNA, 25 nt, Homo Sapiens
gcugagacauucuucaccuccuugg

SEQ ID NO: 2806 - RNA, 23 nt, Homo Sapiens
gcugaggcaggagaaucacugga

SEQ ID NO: 2807 - RNA, 23 nt, Homo Sapiens
gcugggagacacagcaagacucc

SEQ ID NO: 2808 - RNA, 23 nt, Homo Sapiens
gcuccuccccgcgugccuucgcc

SEQ ID NO: 2809 - RNA, 19 nt, Homo Sapiens
gccaguauucuuuuauaaa

SEQ ID NO: 2810 - RNA, 22 nt, Homo Sapiens
ggucgccugcauuucuccgugc

SEQ ID NO: 2811 - RNA, 23 nt, Homo Sapiens
ccgguccucuggcaugucuucag

SEQ ID NO: 2812 - RNA, 27 nt, Homo Sapiens
cuuuguuguuugaauggaaauggaaaa

SEQ ID NO: 2813 - RNA, 21 nt, Homo Sapiens
auccccaccccaccccgacgu

SEQ ID NO: 2814 - RNA, 19 nt, Homo Sapiens
agugcucccuuccuccuca

SEQ ID NO: 2815 - RNA, 31 nt, Homo Sapiens
auacuauuuauuucagggcugggcuauaaca

SEQ ID NO: 2816 - RNA, 23 nt, Homo Sapiens
cauccucccucucgucuuucgca

SEQ ID NO: 2817 - RNA, 23 nt, Homo Sapiens
caucggccgccuccagcucccgg

SEQ ID NO: 2818 - RNA, 18 nt, Homo Sapiens
ccaguauucuuuuauaaa

SEQ ID NO: 2819 - RNA, 26 nt, Homo Sapiens
ccccgccucugcccucauccucccuc

SEQ ID NO: 2820 - RNA, 25 nt, Homo Sapiens
accguggggaagggccccacucagg

SEQ ID NO: 2821 - RNA, 20 nt, Homo Sapiens
uagugcucccuuccuccuca

SEQ ID NO: 2822 - RNA, 22 nt, Homo Sapiens
uauuuauuucagggcugggcua

SEQ ID NO: 2823 - RNA, 24 nt, Homo Sapiens
ugaguggucggaccguggggaagg

SEQ ID NO: 2824 - RNA, 22 nt, Homo Sapiens
uauucuacucaaacuuaugucu

SEQ ID NO: 2825 - RNA, 22 nt, Homo Sapiens
uaguguuugcauuccugguuau

SEQ ID NO: 2826 - RNA, 25 nt, Homo Sapiens
uacugcacucugcuguuagaagcag

SEQ ID NO: 2827 - RNA, 23 nt, Homo Sapiens
uaccuaggagcuguggauguaau

SEQ ID NO: 2828 - RNA, 21 nt, Homo Sapiens
uaaaucacaggaagaagcggc

SEQ ID NO: 2829 - RNA, 23 nt, Homo Sapiens
uccagagagcagggaacuaccuu

SEQ ID NO: 2830 - RNA, 28 nt, Homo Sapiens
uccagagagcagggaacuaccuugagua

SEQ ID NO: 2831 - RNA, 20 nt, Homo Sapiens
acucaaacuuaugucucaga

SEQ ID NO: 2832 - RNA, 22 nt, Homo Sapiens
aaggcugaguccacacugcaag

SEQ ID NO: 2833 - RNA, 19 nt, Homo Sapiens
ccacagcuugcuaguucug

SEQ ID NO: 2834 - RNA, 21 nt, Homo Sapiens
cagcccaguaggagucaugua

SEQ ID NO: 2835 - RNA, 25 nt, Homo Sapiens
auuuuucuaaacgcuuacagauucc

SEQ ID NO: 2836 - RNA, 26 nt, Homo Sapiens
cuucauaaucaaauauaugacauaua

SEQ ID NO: 2837 - RNA, 23 nt, Homo Sapiens
gaaggcugaguccacacugcaag

SEQ ID NO: 2838 - RNA, 21 nt, Homo Sapiens
ccugguuauauguaaugugau

SEQ ID NO: 2839 - RNA, 21 nt, Homo Sapiens
ggugcuggugacuuucuguuc

SEQ ID NO: 2840 - RNA, 32 nt, Homo Sapiens
gccaaagcauggguuucaacacguuuuguauu

SEQ ID NO: 2841 - RNA, 22 nt, Homo Sapiens
gcauuuucuucacuugcaggca

SEQ ID NO: 2842 - RNA, 24 nt, Homo Sapiens
ggaggcggaggucugaguuucgag

SEQ ID NO: 2843 - RNA, 23 nt, Homo Sapiens
ggcuaggaggcucgaccaccuca

SEQ ID NO: 2844 - RNA, 20 nt, Homo Sapiens
gggcggcggcaggccuagca

SEQ ID NO: 2845 - RNA, 19 nt, Homo Sapiens
ccggaucgaugugcugcug

SEQ ID NO: 2846 - RNA, 21 nt, Homo Sapiens
cggccccugaaguggagcgag

SEQ ID NO: 2847 - RNA, 21 nt, Homo Sapiens
gagagggaggugcuucgccgu

SEQ ID NO: 2848 - RNA, 22 nt, Homo Sapiens
augggaaaacuucacuccaaag

SEQ ID NO: 2849 - RNA, 21 nt, Homo Sapiens
caugagacgcuacugcagcuu

SEQ ID NO: 2850 - RNA, 21 nt, Homo Sapiens
aacgagggggagggagguccc

SEQ ID NO: 2851 - RNA, 28 nt, Homo Sapiens
agcuuuugccuugguucuuccuagugcc

SEQ ID NO: 2852 - RNA, 23 nt, Homo Sapiens
ucaggauaacagagaaugguggu

SEQ ID NO: 2853 - RNA, 20 nt, Homo Sapiens
uccggaucgaugugcugcug

SEQ ID NO: 2854 - RNA, 24 nt, Homo Sapiens
guugccggccccugaaguggagcg

SEQ ID NO: 2855 - RNA, 27 nt, Homo Sapiens
uauuucuuacguacacuguacuucugu

SEQ ID NO: 2856 - RNA, 23 nt, Homo Sapiens
ugccuugguucuuccuagugccu

SEQ ID NO: 2857 - RNA, 22 nt, Homo Sapiens
ugaacagauauuuuuaacuuaa

SEQ ID NO: 2858 - RNA, 19 nt, Homo Sapiens
ucuuccuagugccuacaau

SEQ ID NO: 2859 - RNA, 26 nt, Homo Sapiens
ucuuuuauauugauaacagcacugac

SEQ ID NO: 2860 - RNA, 21 nt, Homo Sapiens
ugcgccacuacacuccagccu

SEQ ID NO: 2861 - RNA, 22 nt, Homo Sapiens
ugccuguaaucccagcacuugg

SEQ ID NO: 2862 - RNA, 27 nt, Homo Sapiens
ugccuguaaucccagcacuuggagagg

SEQ ID NO: 2863 - RNA, 22 nt, Homo Sapiens
uggcucaugccuguaaucccag

SEQ ID NO: 2864 - RNA, 20 nt, Homo Sapiens
uauuuaguucucagcucuuc

SEQ ID NO: 2865 - RNA, 24 nt, Homo Sapiens
guuuuuaaaauaucuuuugaccug

SEQ ID NO: 2866 - RNA, 21 nt, Homo Sapiens
uccagccugggugacagagug

SEQ ID NO: 2867 - RNA, 24 nt, Homo Sapiens
uuugaggcuuucagguuuuaguuu

SEQ ID NO: 2868 - RNA, 22 nt, Homo Sapiens
uugcgccacuacacuccagccu

SEQ ID NO: 2869 - RNA, 23 nt, Homo Sapiens
uuccugcgccccagacuccaggc

SEQ ID NO: 2870 - RNA, 23 nt, Homo Sapiens
agccuggcgguagaaucuuccca

SEQ ID NO: 2871 - RNA, 20 nt, Homo Sapiens
agcacagacucacauaugga

SEQ ID NO: 2872 - RNA, 26 nt, Homo Sapiens
acuuccugcagguaaacaguucuugu

SEQ ID NO: 2873 - RNA, 22 nt, Homo Sapiens
acuccagccugggugacagagu

SEQ ID NO: 2874 - RNA, 18 nt, Homo Sapiens
accauccggucaccagaa

SEQ ID NO: 2875 - RNA, 22 nt, Homo Sapiens
caugccuguaaucccagcacuu

SEQ ID NO: 2876 - RNA, 22 nt, Homo Sapiens
ccacuacacuccagccugggug

SEQ ID NO: 2877 - RNA, 19 nt, Homo Sapiens
ccagaagugaaaaggcugc

SEQ ID NO: 2878 - RNA, 21 nt, Homo Sapiens
ccagagaauggacaccaucca

SEQ ID NO: 2879 - RNA, 23 nt, Homo Sapiens
ccagagagguggagucgguagcg

SEQ ID NO: 2880 - RNA, 28 nt, Homo Sapiens
ccagagagguggagucgguagcggggcc

SEQ ID NO: 2881 - RNA, 22 nt, Homo Sapiens
cagcacuuggagaggcugaggu

SEQ ID NO: 2882 - RNA, 17 nt, Homo Sapiens
caggccgccugcagccu

SEQ ID NO: 2883 - RNA, 21 nt, Homo Sapiens
ccagccugggugacagaguga

SEQ ID NO: 2884 - RNA, 21 nt, Homo Sapiens
cccagcacuuggagaggcuga

SEQ ID NO: 2885 - RNA, 26 nt, Homo Sapiens
auguagcagggaaaauauauaucuaa

SEQ ID NO: 2886 - RNA, 22 nt, Homo Sapiens
cacuacacuccagccuggguga

SEQ ID NO: 2887 - RNA, 26 nt, Homo Sapiens
auagauuugaccuacaaaucaaucac

SEQ ID NO: 2888 - RNA, 28 nt, Homo Sapiens
agguugcgccacuacacuccagccuggg

SEQ ID NO: 2889 - RNA, 24 nt, Homo Sapiens
agugacuuagcagaugcuggucau

SEQ ID NO: 2890 - RNA, 19 nt, Homo Sapiens
gaccauccggucaccagaa

SEQ ID NO: 2891 - RNA, 22 nt, Homo Sapiens
gagguugcgccacuacacucca

SEQ ID NO: 2892 - RNA, 22 nt, Homo Sapiens
cuucaacuaaaaacaaaggaga

SEQ ID NO: 2893 - RNA, 22 nt, Homo Sapiens
cgccacuacacuccagccuggg

SEQ ID NO: 2894 - RNA, 23 nt, Homo Sapiens
cuacaaaucaaucacagcuugua

SEQ ID NO: 2895 - RNA, 18 nt, Homo Sapiens
cugacuuaagugugcaaa

SEQ ID NO: 2896 - RNA, 20 nt, Homo Sapiens
ccuguaaucccagcacuugg

SEQ ID NO: 2897 - RNA, 23 nt, Homo Sapiens
gggcccugauuugcugggcaguu

SEQ ID NO: 2898 - RNA, 15 nt, Homo Sapiens
ggcaguuuuucugua

SEQ ID NO: 2899 - RNA, 22 nt, Homo Sapiens
gcucaugccuguaaucccagca

SEQ ID NO: 2900 - RNA, 21 nt, Homo Sapiens
gccuguaaucccagcacuugg

SEQ ID NO: 2901 - RNA, 27 nt, Homo Sapiens
gccuauuguuaaagauuugcaugugaa

SEQ ID NO: 2902 - RNA, 21 nt, Homo Sapiens
gugaacaaagggaaaauucua

SEQ ID NO: 2903 - RNA, 22 nt, Homo Sapiens
gugcaaagagaauuaggagaga

SEQ ID NO: 2904 - RNA, 24 nt, Homo Sapiens
gugaugauuuucagaaaguuguug

SEQ ID NO: 2905 - RNA, 23 nt, Homo Sapiens
ccugguucuauuaaaauauccau

SEQ ID NO: 2906 - RNA, 21 nt, Homo Sapiens
ccuugcaauauagaaaaacuu

SEQ ID NO: 2907 - RNA, 23 nt, Homo Sapiens
cugcuucucuuacuauacucaua

SEQ ID NO: 2908 - RNA, 22 nt, Homo Sapiens
gagcaauuaaaccacuauucca

SEQ ID NO: 2909 - RNA, 26 nt, Homo Sapiens
gcacacaccuaaagauaucuuuuuag

SEQ ID NO: 2910 - RNA, 27 nt, Homo Sapiens
gaaaugaggccuguacaaggcugauaa

SEQ ID NO: 2911 - RNA, 26 nt, Homo Sapiens
aguuugaauaguuagacauggaaauu

SEQ ID NO: 2912 - RNA, 21 nt, Homo Sapiens
aucucaguguaucuagucacu

SEQ ID NO: 2913 - RNA, 27 nt, Homo Sapiens
augggcagaaucugcucucugugacca

SEQ ID NO: 2914 - RNA, 26 nt, Homo Sapiens
caaauuaaugcauaauuucagaugua

SEQ ID NO: 2915 - RNA, 24 nt, Homo Sapiens
cccaacaacauuaaaaaauacucg

SEQ ID NO: 2916 - RNA, 21 nt, Homo Sapiens
ccagugccauuugucugugca

SEQ ID NO: 2917 - RNA, 21 nt, Homo Sapiens
cagcaaguuuucuaucauguc

SEQ ID NO: 2918 - RNA, 20 nt, Homo Sapiens
acuauauuacaucauuucag

SEQ ID NO: 2919 - RNA, 22 nt, Homo Sapiens
acugaucacuauauuacaucau

SEQ ID NO: 2920 - RNA, 17 nt, Homo Sapiens
acugucucccccuuguc

SEQ ID NO: 2921 - RNA, 20 nt, Homo Sapiens
acugucucccccuugucacc

SEQ ID NO: 2922 - RNA, 23 nt, Homo Sapiens
aauucagagaaauggaguguuca

SEQ ID NO: 2923 - RNA, 22 nt, Homo Sapiens
acaaaauuuauuuuuauuuuuu

SEQ ID NO: 2924 - RNA, 22 nt, Homo Sapiens
acuuaaaaccuuugacugccug

SEQ ID NO: 2925 - RNA, 23 nt, Homo Sapiens
aaccuauaugugauggagaucac

SEQ ID NO: 2926 - RNA, 18 nt, Homo Sapiens
aacacugaugaauguaaa

SEQ ID NO: 2927 - RNA, 26 nt, Homo Sapiens
aagacuguuuccacaccauaggcaau

SEQ ID NO: 2928 - RNA, 25 nt, Homo Sapiens
aaaaagugguuaauauuaauaagac

SEQ ID NO: 2929 - RNA, 23 nt, Homo Sapiens
aaaaauucauaguaauccugcca

SEQ ID NO: 2930 - RNA, 19 nt, Homo Sapiens
aaaccuuugacugccugua

SEQ ID NO: 2931 - RNA, 27 nt, Homo Sapiens
uucaguauuuucuuaagaaauugcuuu

SEQ ID NO: 2932 - RNA, 22 nt, Homo Sapiens
uuuccauuguugcaucuugaau

SEQ ID NO: 2933 - RNA, 21 nt, Homo Sapiens
ucuccaccuuuuucuuaugag

SEQ ID NO: 2934 - RNA, 27 nt, Homo Sapiens
ucuccaccuuuuucuuaugagucucac

SEQ ID NO: 2935 - RNA, 20 nt, Homo Sapiens
uacucugcuucucuuacuau

SEQ ID NO: 2936 - RNA, 19 nt, Homo Sapiens
uaacuggaggauucagcac

SEQ ID NO: 2937 - RNA, 27 nt, Homo Sapiens
uauauuuucacaacuacuuucucucuc

SEQ ID NO: 2938 - RNA, 32 nt, Homo Sapiens
uauauuuucacaacuacuuucucucuccagag

SEQ ID NO: 2939 - RNA, 26 nt, Homo Sapiens
uaguaauccugccaaaugugccuauu

SEQ ID NO: 2940 - RNA, 21 nt, Homo Sapiens
ucugcagcuauuucaacuucc

SEQ ID NO: 2941 - RNA, 25 nt, Homo Sapiens
uggaaggaagcaggauggcagccgg

SEQ ID NO: 2942 - RNA, 25 nt, Homo Sapiens
ucuccuguauaaccccaccuugcca

SEQ ID NO: 2943 - RNA, 26 nt, Homo Sapiens
caccuugccaagcuuucuucuacaac

SEQ ID NO: 2944 - RNA, 26 nt, Homo Sapiens
cucuccuguauaaccccaccuugcca

SEQ ID NO: 2945 - RNA, 21 nt, Homo Sapiens
ggcaggcgagaguaguacugg

SEQ ID NO: 2946 - RNA, 20 nt, Homo Sapiens
gcaggcgagaguaguacugg

SEQ ID NO: 2947 - RNA, 25 nt, Homo Sapiens
ggcuuaaagcauccuccuccuggac

SEQ ID NO: 2948 - RNA, 28 nt, Homo Sapiens
gugccuaaaacccaguugcugaucccug

SEQ ID NO: 2949 - RNA, 23 nt, Homo Sapiens
guggccaggcaggcgggggcugc

SEQ ID NO: 2950 - RNA, 22 nt, Homo Sapiens
cucuccucuucgugguuguguu

SEQ ID NO: 2951 - RNA, 18 nt, Homo Sapiens
cucuucgugguuguguuu

SEQ ID NO: 2952 - RNA, 23 nt, Homo Sapiens
ccugcucccaccaccagugagac

SEQ ID NO: 2953 - RNA, 19 nt, Homo Sapiens
gauccccuggaaacccacc

SEQ ID NO: 2954 - RNA, 22 nt, Homo Sapiens
cugcccucucugcgcugaggcc

SEQ ID NO: 2955 - RNA, 22 nt, Homo Sapiens
cagacuucuuaaaaggagcucg

SEQ ID NO: 2956 - RNA, 21 nt, Homo Sapiens
auccugagagaccugcccucu

SEQ ID NO: 2957 - RNA, 21 nt, Homo Sapiens
ccaaccuuaaaccucuucuau

SEQ ID NO: 2958 - RNA, 27 nt, Homo Sapiens
ccaggauaaaaggggaaauaacugccu

SEQ ID NO: 2959 - RNA, 23 nt, Homo Sapiens
cccuccagcaccacuuuggcuua

SEQ ID NO: 2960 - RNA, 27 nt, Homo Sapiens
agccaaccuuaaaccucuucuauugcu

SEQ ID NO: 2961 - RNA, 19 nt, Homo Sapiens
aggauggagagcagccagc

SEQ ID NO: 2962 - RNA, 21 nt, Homo Sapiens
aggcagcagcggcuggagcgg

SEQ ID NO: 2963 - RNA, 24 nt, Homo Sapiens
acucccuugaggauggagagcagc

SEQ ID NO: 2964 - RNA, 21 nt, Homo Sapiens
ugcuugagggagaauccuccc

SEQ ID NO: 2965 - RNA, 25 nt, Homo Sapiens
uggcgcuggaggcagcagcggcugg

SEQ ID NO: 2966 - RNA, 22 nt, Homo Sapiens
ugagccaaccuuaaaccucuuc

SEQ ID NO: 2967 - RNA, 22 nt, Homo Sapiens
ugacuaaugaccacaccugccu

SEQ ID NO: 2968 - RNA, 25 nt, Homo Sapiens
ugucuucucccugcacaagccaggg

SEQ ID NO: 2969 - RNA, 24 nt, Homo Sapiens
ucuaggguuuuccaaugugacuaa

SEQ ID NO: 2970 - RNA, 20 nt, Homo Sapiens
guuuguaaagcguuccaagu

SEQ ID NO: 2971 - RNA, 21 nt, Homo Sapiens
uucuugugucuggagauucug

SEQ ID NO: 2972 - RNA, 22 nt, Homo Sapiens
acucauuuuaguggcugccucc

SEQ ID NO: 2973 - RNA, 23 nt, Homo Sapiens
acuguccuguggacagacggggu

SEQ ID NO: 2974 - RNA, 22 nt, Homo Sapiens
cagcccagccacggacgcuggc

SEQ ID NO: 2975 - RNA, 17 nt, Homo Sapiens
caaaggagagucacaga

SEQ ID NO: 2976 - RNA, 20 nt, Homo Sapiens
caacaugaaaacuccauauu

SEQ ID NO: 2977 - RNA, 22 nt, Homo Sapiens
augauggccacaacaugaaaac

SEQ ID NO: 2978 - RNA, 17 nt, Homo Sapiens
cugccucucccgucguc

SEQ ID NO: 2979 - RNA, 26 nt, Homo Sapiens
cugucuucucccugcacaagccaggg

SEQ ID NO: 2980 - RNA, 17 nt, Homo Sapiens
ggguuuuccaaugugac

SEQ ID NO: 2981 - RNA, 27 nt, Homo Sapiens
ggcccccacaauggucccaaacagcug

SEQ ID NO: 2982 - RNA, 18 nt, Homo Sapiens
gccagccgugagugcaga

SEQ ID NO: 2983 - RNA, 22 nt, Homo Sapiens
gcugccucugccacugacugca

SEQ ID NO: 2984 - RNA, 27 nt, Homo Sapiens
ggagugguaacaagaggagcaggaagc

SEQ ID NO: 2985 - RNA, 23 nt, Homo Sapiens
gccaggccucauccuccuggacc

SEQ ID NO: 2986 - RNA, 20 nt, Homo Sapiens
ggccccagggaacuaaaggg

SEQ ID NO: 2987 - RNA, 22 nt, Homo Sapiens
ggcuauuccuaggccucaggcc

SEQ ID NO: 2988 - RNA, 21 nt, Homo Sapiens
gggucccuucccccugcucca

SEQ ID NO: 2989 - RNA, 26 nt, Homo Sapiens
gggugugggucagggaggggucuaga

SEQ ID NO: 2990 - RNA, 21 nt, Homo Sapiens
cuacgguucccugccuaggag

SEQ ID NO: 2991 - RNA, 24 nt, Homo Sapiens
aucuaaucccuucaaggaagugau

SEQ ID NO: 2992 - RNA, 23 nt, Homo Sapiens
aggcuauuccuaggccucaggcc

SEQ ID NO: 2993 - RNA, 19 nt, Homo Sapiens
cagggaggggucuagaggc

SEQ ID NO: 2994 - RNA, 27 nt, Homo Sapiens
cccugcuccaugggcaccucugcugua

SEQ ID NO: 2995 - RNA, 27 nt, Homo Sapiens
cccuucccccugcuccaugggcaccuc

SEQ ID NO: 2996 - RNA, 27 nt, Homo Sapiens
cccagcuccccggaugaaacagauaua

SEQ ID NO: 2997 - RNA, 26 nt, Homo Sapiens
ccaguuuaaaagaguuugaaggagca

SEQ ID NO: 2998 - RNA, 21 nt, Homo Sapiens
cccaccccuccuagugaacua

SEQ ID NO: 2999 - RNA, 23 nt, Homo Sapiens
ccaacuggcagcuuucccugaca

SEQ ID NO: 3000 - RNA, 21 nt, Homo Sapiens
ccaaaacagcauuuuccugcu

SEQ ID NO: 3001 - RNA, 27 nt, Homo Sapiens
aucucccaccccagagaacgaggauuu

SEQ ID NO: 3002 - RNA, 20 nt, Homo Sapiens
aguucuguaacgccaucucc

SEQ ID NO: 3003 - RNA, 31 nt, Homo Sapiens
augcagaucuggaaaccucagccagagaacu

SEQ ID NO: 3004 - RNA, 23 nt, Homo Sapiens
auguucucucgucuugccaccau

SEQ ID NO: 3005 - RNA, 21 nt, Homo Sapiens
caacaaauuacauuagguuga

SEQ ID NO: 3006 - RNA, 22 nt, Homo Sapiens
cagaccccaguccagcccugaa

SEQ ID NO: 3007 - RNA, 23 nt, Homo Sapiens
cacaucccaacaggaacgacuca

SEQ ID NO: 3008 - RNA, 22 nt, Homo Sapiens
agaauuauaguucacuauggcc

SEQ ID NO: 3009 - RNA, 19 nt, Homo Sapiens
agcauuuuccugcuccuuc

SEQ ID NO: 3010 - RNA, 27 nt, Homo Sapiens
agcauuuuccugcuccuucguauguag

SEQ ID NO: 3011 - RNA, 19 nt, Homo Sapiens
agccccacugcagucauca

SEQ ID NO: 3012 - RNA, 20 nt, Homo Sapiens
agccuuucauccuuaguuug

SEQ ID NO: 3013 - RNA, 19 nt, Homo Sapiens
acacauggacaccauuuca

SEQ ID NO: 3014 - RNA, 20 nt, Homo Sapiens
acagcauuuuccugcuccuu

SEQ ID NO: 3015 - RNA, 21 nt, Homo Sapiens
aaagcugaggcugacaauaau

SEQ ID NO: 3016 - RNA, 25 nt, Homo Sapiens
aaagagccccacccacaggauuccu

SEQ ID NO: 3017 - RNA, 19 nt, Homo Sapiens
aauacuccucaucagccuu

SEQ ID NO: 3018 - RNA, 23 nt, Homo Sapiens
cuacagcuguuugugggauguug

SEQ ID NO: 3019 - RNA, 20 nt, Homo Sapiens
cguccuuggaaugaaugaug

SEQ ID NO: 3020 - RNA, 22 nt, Homo Sapiens
cucugccaacaucaagcuggug

SEQ ID NO: 3021 - RNA, 25 nt, Homo Sapiens
ccucccaaaugcaggaaaaaauaug

SEQ ID NO: 3022 - RNA, 25 nt, Homo Sapiens
ccucagccagagaacuagagcagaa

SEQ ID NO: 3023 - RNA, 21 nt, Homo Sapiens
ccuggcaccgagcgaugagga

SEQ ID NO: 3024 - RNA, 23 nt, Homo Sapiens
cuguaaaaauaggauggcgaguu

SEQ ID NO: 3025 - RNA, 21 nt, Homo Sapiens
gaaacuucaaaauugaugaaa

SEQ ID NO: 3026 - RNA, 27 nt, Homo Sapiens
gcacagccccugcugggaaauggcucu

SEQ ID NO: 3027 - RNA, 22 nt, Homo Sapiens
gaucuccaggguucuaggaaag

SEQ ID NO: 3028 - RNA, 26 nt, Homo Sapiens
gaaguuagaggguaaagagccccacc

SEQ ID NO: 3029 - RNA, 26 nt, Homo Sapiens
guaccaaagaccugggaaaacuaacc

SEQ ID NO: 3030 - RNA, 23 nt, Homo Sapiens
guaguaucaacagugacccagaa

SEQ ID NO: 3031 - RNA, 20 nt, Homo Sapiens
gucuucuuggcuggaccugu

SEQ ID NO: 3032 - RNA, 25 nt, Homo Sapiens
gcccagccacaccaccaaacacccu

SEQ ID NO: 3033 - RNA, 23 nt, Homo Sapiens
gcauuuugggugggacauauuuc

SEQ ID NO: 3034 - RNA, 21 nt, Homo Sapiens
gcuagagguaaacguucugcu

SEQ ID NO: 3035 - RNA, 21 nt, Homo Sapiens
ggaauucugcauccagcucua

SEQ ID NO: 3036 - RNA, 21 nt, Homo Sapiens
gcucuaucccccucugaugcu

SEQ ID NO: 3037 - RNA, 27 nt, Homo Sapiens
ugugauuuuugcuaguccaugugcuag

SEQ ID NO: 3038 - RNA, 21 nt, Homo Sapiens
uguggucggaucugcccagcc

SEQ ID NO: 3039 - RNA, 19 nt, Homo Sapiens
uguuguccaggcagcucau

SEQ ID NO: 3040 - RNA, 23 nt, Homo Sapiens
uuuuccauuuuacuuugaagauu

SEQ ID NO: 3041 - RNA, 24 nt, Homo Sapiens
guugaaccuuuccuugauuuuaug

SEQ ID NO: 3042 - RNA, 26 nt, Homo Sapiens
guucugcuggaauucugcauccagcu

SEQ ID NO: 3043 - RNA, 22 nt, Homo Sapiens
uagucuuguuuacuucuucuua

SEQ ID NO: 3044 - RNA, 27 nt, Homo Sapiens
uccucaucagccuuucauccuuaguuu

SEQ ID NO: 3045 - RNA, 26 nt, Homo Sapiens
uccagcuggacaacguugucccaaga

SEQ ID NO: 3046 - RNA, 27 nt, Homo Sapiens
ucccaaaacagcauuuuccugcuccuu

SEQ ID NO: 3047 - RNA, 24 nt, Homo Sapiens
ucccagcccaggagaacuaagagc

SEQ ID NO: 3048 - RNA, 22 nt, Homo Sapiens
ucauccagcccagaaaccaaga

SEQ ID NO: 3049 - RNA, 24 nt, Homo Sapiens
ugucuucuuggcuggaccugucac

SEQ ID NO: 3050 - RNA, 22 nt, Homo Sapiens
uguaaaaauaggauggcgaguu

SEQ ID NO: 3051 - RNA, 24 nt, Homo Sapiens
ugggugggacauauuucaaacuuc

SEQ ID NO: 3052 - RNA, 23 nt, Homo Sapiens
ugcugaugcuuugucuucagaga

SEQ ID NO: 3053 - RNA, 26 nt, Homo Sapiens
ugacaccuuggcaguguuuauggcca

SEQ ID NO: 3054 - RNA, 26 nt, Homo Sapiens
ugcagcuagagaauuauaguucacua

SEQ ID NO: 3055 - RNA, 20 nt, Homo Sapiens
ucugcuacccucauccuggu

SEQ ID NO: 3056 - RNA, 26 nt, Homo Sapiens
uguugucugcuacccucauccugguc

SEQ ID NO: 3057 - RNA, 21 nt, Homo Sapiens
cuggucacugcuucugcuaua

SEQ ID NO: 3058 - RNA, 22 nt, Homo Sapiens
cuagggggacagccacuguguu

SEQ ID NO: 3059 - RNA, 30 nt, Homo Sapiens
acaucugcagucuuucuucuuugaauuucc

SEQ ID NO: 3060 - RNA, 21 nt, Homo Sapiens
cccucauccuggucacugcuu

SEQ ID NO: 3061 - RNA, 21 nt, Homo Sapiens
auucacccucucauguuuccc

SEQ ID NO: 3062 - RNA, 25 nt, Homo Sapiens
agggcagcagggagucuugaaguga

SEQ ID NO: 3063 - RNA, 21 nt, Homo Sapiens
acucccagccuagggcagcag

SEQ ID NO: 3064 - RNA, 22 nt, Homo Sapiens
cuagggcagcagggagucuuga

SEQ ID NO: 3065 - RNA, 20 nt, Homo Sapiens
ccuccccucuuccuggagcc

SEQ ID NO: 3066 - RNA, 24 nt, Homo Sapiens
ggaaauucuuauuuccccuuucca

SEQ ID NO: 3067 - RNA, 23 nt, Homo Sapiens
gccgggccgggcgggagugcagg

SEQ ID NO: 3068 - RNA, 22 nt, Homo Sapiens
ggccgggcgggagugcagggga

SEQ ID NO: 3069 - RNA, 21 nt, Homo Sapiens
gggccgggcgggagugcaggg

SEQ ID NO: 3070 - RNA, 24 nt, Homo Sapiens
gggcagcagggagucuugaaguga

SEQ ID NO: 3071 - RNA, 21 nt, Homo Sapiens
uccccacguggcaccuccuca

SEQ ID NO: 3072 - RNA, 27 nt, Homo Sapiens
uccucaccuuaauuuauuuuuuaaguu

SEQ ID NO: 3073 - RNA, 25 nt, Homo Sapiens
ucaacucuucagccucauucacugu

SEQ ID NO: 3074 - RNA, 24 nt, Homo Sapiens
uacuacuguagaacugcaauuucc

SEQ ID NO: 3075 - RNA, 27 nt, Homo Sapiens
uacuacuguagaacugcaauuuccauu

SEQ ID NO: 3076 - RNA, 17 nt, Homo Sapiens
ucugacauccugaccuc

SEQ ID NO: 3077 - RNA, 26 nt, Homo Sapiens
ugaaacugagucuguggacacugugg

SEQ ID NO: 3078 - RNA, 19 nt, Homo Sapiens
ugcucacugcuucugcuuu

SEQ ID NO: 3079 - RNA, 26 nt, Homo Sapiens
ugcugagaaaugggguggaauaggga

SEQ ID NO: 3080 - RNA, 21 nt, Homo Sapiens
ugggguggaauagggaacugu

SEQ ID NO: 3081 - RNA, 21 nt, Homo Sapiens
uuguauugucugacacaugcu

SEQ ID NO: 3082 - RNA, 21 nt, Homo Sapiens
uugucugacacaugcucucaa

SEQ ID NO: 3083 - RNA, 17 nt, Homo Sapiens
gcucacugcuucugcuu

SEQ ID NO: 3084 - RNA, 18 nt, Homo Sapiens
gcucacugcuucugcuuu

SEQ ID NO: 3085 - RNA, 19 nt, Homo Sapiens
gcucacugcuucugcuuuu

SEQ ID NO: 3086 - RNA, 25 nt, Homo Sapiens
ccuccacccccuccugucaccggcc

SEQ ID NO: 3087 - RNA, 24 nt, Homo Sapiens
ccucuacuuuguccccucaccucc

SEQ ID NO: 3088 - RNA, 26 nt, Homo Sapiens
ccucauucacuguccuggcuuuuauu

SEQ ID NO: 3089 - RNA, 20 nt, Homo Sapiens
ccgcugcugcuuuccuucgg

SEQ ID NO: 3090 - RNA, 22 nt, Homo Sapiens
cgucuucuagagagcuuagugu

SEQ ID NO: 3091 - RNA, 24 nt, Homo Sapiens
cuccacccccuccugucaccggcc

SEQ ID NO: 3092 - RNA, 26 nt, Homo Sapiens
cuggauaccugugugucuccauaaaa

SEQ ID NO: 3093 - RNA, 22 nt, Homo Sapiens
gacuauauaaaguacuacugua

SEQ ID NO: 3094 - RNA, 22 nt, Homo Sapiens
gagucuguggacacuguggaaa

SEQ ID NO: 3095 - RNA, 25 nt, Homo Sapiens
gaggaguccgagugugugagcuuga

SEQ ID NO: 3096 - RNA, 27 nt, Homo Sapiens
acugagucuguggacacuguggaaagc

SEQ ID NO: 3097 - RNA, 22 nt, Homo Sapiens
auuguauugucugacacaugcu

SEQ ID NO: 3098 - RNA, 21 nt, Homo Sapiens
augcuuguacaguugaugucg

SEQ ID NO: 3099 - RNA, 26 nt, Homo Sapiens
ccagugcuuccacagagauuagccug

SEQ ID NO: 3100 - RNA, 27 nt, Homo Sapiens
cccuccagcaaggauucaggagugccc

SEQ ID NO: 3101 - RNA, 17 nt, Homo Sapiens
accaauaaaaauccuac

SEQ ID NO: 3102 - RNA, 23 nt, Homo Sapiens
agcgccugugcugaggacucccg

SEQ ID NO: 3103 - RNA, 26 nt, Homo Sapiens
gacucaugggaccugaagggugacau

SEQ ID NO: 3104 - RNA, 20 nt, Homo Sapiens
ccuccagcaaggauucagga

SEQ ID NO: 3105 - RNA, 22 nt, Homo Sapiens
ggugacauccaggaggggccuc

SEQ ID NO: 3106 - RNA, 27 nt, Homo Sapiens
gggcggguggggaggggugcucugcug

SEQ ID NO: 3107 - RNA, 15 nt, Homo Sapiens
ggcggaucccacucg

SEQ ID NO: 3108 - RNA, 21 nt, Homo Sapiens
cgugccuguuuuaugugcaca

SEQ ID NO: 3109 - RNA, 19 nt, Homo Sapiens
acggggcggguggggaggg

SEQ ID NO: 3110 - RNA, 22 nt, Homo Sapiens
cauguaaauaaauacauucuug

SEQ ID NO: 3111 - RNA, 20 nt, Homo Sapiens
augugggaagaaacaaaccc

SEQ ID NO: 3112 - RNA, 22 nt, Homo Sapiens
aguucagcugcuucucuugccu

SEQ ID NO: 3113 - RNA, 24 nt, Homo Sapiens
aucccuguucauuguaagcacuuu

SEQ ID NO: 3114 - RNA, 21 nt, Homo Sapiens
uuuccugaucacuaugcauuu

SEQ ID NO: 3115 - RNA, 22 nt, Homo Sapiens
uuggguggggagaagaggcaga

SEQ ID NO: 3116 - RNA, 21 nt, Homo Sapiens
uggguggggagaagaggcaga

SEQ ID NO: 3117 - RNA, 23 nt, Homo Sapiens
ugccugaacuugaauuaauccac

SEQ ID NO: 3118 - RNA, 22 nt, Homo Sapiens
uacuacauuauuaauggguuuu

SEQ ID NO: 3119 - RNA, 23 nt, Homo Sapiens
ucucuauacuacauuauuaaugg

SEQ ID NO: 3120 - RNA, 20 nt, Homo Sapiens
ucucuccugauuauuuauca

SEQ ID NO: 3121 - RNA, 23 nt, Homo Sapiens
ucccuguucauuguaagcacuuu

SEQ ID NO: 3122 - RNA, 22 nt, Homo Sapiens
uccgaguagcugggauuacagg

SEQ ID NO: 3123 - RNA, 24 nt, Homo Sapiens
guuaccucaauucuuacuguagua

SEQ ID NO: 3124 - RNA, 20 nt, Homo Sapiens
guguacuucaccucuuggcu

SEQ ID NO: 3125 - RNA, 23 nt, Homo Sapiens
guugcccaggcugggagggcaau

SEQ ID NO: 3126 - RNA, 24 nt, Homo Sapiens
guugcccaggcugggagggcaaug

SEQ ID NO: 3127 - RNA, 27 nt, Homo Sapiens
guugcccaggcugggagggcaauggca

SEQ ID NO: 3128 - RNA, 24 nt, Homo Sapiens
ucaaaucucugucucugcuugguu

SEQ ID NO: 3129 - RNA, 27 nt, Homo Sapiens
uauguagaagccuaggaucacagggug

SEQ ID NO: 3130 - RNA, 25 nt, Homo Sapiens
uagugcagacagaaaacugcaguga

SEQ ID NO: 3131 - RNA, 23 nt, Homo Sapiens
ugccaaaacaugauugaagccuu

SEQ ID NO: 3132 - RNA, 21 nt, Homo Sapiens
ugcccaggcugggagggcaau

SEQ ID NO: 3133 - RNA, 23 nt, Homo Sapiens
ugcccaggcugggagggcaaugg

SEQ ID NO: 3134 - RNA, 22 nt, Homo Sapiens
ugcaaccuccgccucccggguu

SEQ ID NO: 3135 - RNA, 24 nt, Homo Sapiens
ugacauuuggauuaaucuccagcu

SEQ ID NO: 3136 - RNA, 20 nt, Homo Sapiens
ugaauuauugaccuaauaaa

SEQ ID NO: 3137 - RNA, 25 nt, Homo Sapiens
ugaaacacugguccaguccauugaa

SEQ ID NO: 3138 - RNA, 22 nt, Homo Sapiens
ucuuccauguggagguauucaa

SEQ ID NO: 3139 - RNA, 21 nt, Homo Sapiens
ugggauuacaggcuccugcca

SEQ ID NO: 3140 - RNA, 19 nt, Homo Sapiens
uugcccaggcugggagggc

SEQ ID NO: 3141 - RNA, 23 nt, Homo Sapiens
uugcccaggcugggagggcaaug

SEQ ID NO: 3142 - RNA, 22 nt, Homo Sapiens
uuguugcccaggcugggagggc

SEQ ID NO: 3143 - RNA, 20 nt, Homo Sapiens
uuuaauauguaauucuucca

SEQ ID NO: 3144 - RNA, 24 nt, Homo Sapiens
uuugaacuucccaaccuuguuuga

SEQ ID NO: 3145 - RNA, 22 nt, Homo Sapiens
uuuuaaaaaauucauuuugcag

SEQ ID NO: 3146 - RNA, 22 nt, Homo Sapiens
uguuugaagcuguuauuugcag

SEQ ID NO: 3147 - RNA, 23 nt, Homo Sapiens
uguugcccaggcugggagggcaa

SEQ ID NO: 3148 - RNA, 24 nt, Homo Sapiens
uguugcccaggcugggagggcaau

SEQ ID NO: 3149 - RNA, 20 nt, Homo Sapiens
uuaggauaaguuagaugugu

SEQ ID NO: 3150 - RNA, 27 nt, Homo Sapiens
uguuuuuaaaaaauucauuuugcagaa

SEQ ID NO: 3151 - RNA, 23 nt, Homo Sapiens
uuaaaaaauucauuuugcagaaa

SEQ ID NO: 3152 - RNA, 20 nt, Homo Sapiens
uuaacacaaguacuaauaaa

SEQ ID NO: 3153 - RNA, 23 nt, Homo Sapiens
uuaagaauuugugacauguagca

SEQ ID NO: 3154 - RNA, 23 nt, Homo Sapiens
uuaccucaauucuuacuguagua

SEQ ID NO: 3155 - RNA, 26 nt, Homo Sapiens
uucaguuauauucagcauguaccgca

SEQ ID NO: 3156 - RNA, 22 nt, Homo Sapiens
uuccagcgauucuccugccuca

SEQ ID NO: 3157 - RNA, 23 nt, Homo Sapiens
uuccagcgauucuccugccucag

SEQ ID NO: 3158 - RNA, 21 nt, Homo Sapiens
aucaaauuuaagaauuuguga

SEQ ID NO: 3159 - RNA, 23 nt, Homo Sapiens
aucugauagaccagcacuucuga

SEQ ID NO: 3160 - RNA, 24 nt, Homo Sapiens
aguuugcccccggaggaggcaggg

SEQ ID NO: 3161 - RNA, 23 nt, Homo Sapiens
aguauagaaaaguuaacacaagu

SEQ ID NO: 3162 - RNA, 18 nt, Homo Sapiens
auuuuuuguaagccaguc

SEQ ID NO: 3163 - RNA, 22 nt, Homo Sapiens
cauugugauauauucuguacuu

SEQ ID NO: 3164 - RNA, 26 nt, Homo Sapiens
caucauuauuggcaguuucuccuuau

SEQ ID NO: 3165 - RNA, 21 nt, Homo Sapiens
ccgagcugcuggggaggaccu

SEQ ID NO: 3166 - RNA, 20 nt, Homo Sapiens
cccaggcugggagggcaaug

SEQ ID NO: 3167 - RNA, 19 nt, Homo Sapiens
ccaggcugggagggcaaug

SEQ ID NO: 3168 - RNA, 25 nt, Homo Sapiens
ccauugcauuuaaguucccuaggag

SEQ ID NO: 3169 - RNA, 22 nt, Homo Sapiens
accuuuguuccuagccuguugg

SEQ ID NO: 3170 - RNA, 22 nt, Homo Sapiens
acugcaaccuccgccucccggg

SEQ ID NO: 3171 - RNA, 27 nt, Homo Sapiens
accacgccuggcuaggaaauuuuuugu

SEQ ID NO: 3172 - RNA, 19 nt, Homo Sapiens
acacugguccaguccauug

SEQ ID NO: 3173 - RNA, 22 nt, Homo Sapiens
agccuuccgaguagcugggauu

SEQ ID NO: 3174 - RNA, 22 nt, Homo Sapiens
agaaaacauugccauuuugguu

SEQ ID NO: 3175 - RNA, 26 nt, Homo Sapiens
aaggaugauuuuaacaacuuuuuaau

SEQ ID NO: 3176 - RNA, 22 nt, Homo Sapiens
aagcaagucuauaaauaucggc

SEQ ID NO: 3177 - RNA, 23 nt, Homo Sapiens
aacuaaaacuuuucaguucuacu

SEQ ID NO: 3178 - RNA, 21 nt, Homo Sapiens
aaacaaaacacuaacaaucuu

SEQ ID NO: 3179 - RNA, 23 nt, Homo Sapiens
cuauuauuucugguucuaaugaa

SEQ ID NO: 3180 - RNA, 20 nt, Homo Sapiens
cucaaagcugacuuugccaa

SEQ ID NO: 3181 - RNA, 22 nt, Homo Sapiens
cgccgucccucaguuugccccc

SEQ ID NO: 3182 - RNA, 18 nt, Homo Sapiens
cggcugcagccauccccc

SEQ ID NO: 3183 - RNA, 21 nt, Homo Sapiens
cucauuucuguauauuccuuu

SEQ ID NO: 3184 - RNA, 27 nt, Homo Sapiens
cucauuucuguauauuccuuuuauggg

SEQ ID NO: 3185 - RNA, 22 nt, Homo Sapiens
ccgaguagcugggauuacaggc

SEQ ID NO: 3186 - RNA, 23 nt, Homo Sapiens
cgaguagcugggauuacaggcuc

SEQ ID NO: 3187 - RNA, 20 nt, Homo Sapiens
gacguacuugcaguuuauga

SEQ ID NO: 3188 - RNA, 26 nt, Homo Sapiens
gaccaguguugaucuguaauguaaua

SEQ ID NO: 3189 - RNA, 27 nt, Homo Sapiens
gaguagcugggauuacaggcuccugcc

SEQ ID NO: 3190 - RNA, 23 nt, Homo Sapiens
gauaaugcaaaaauuauguaaua

SEQ ID NO: 3191 - RNA, 22 nt, Homo Sapiens
gaugaagcaaacccacacccua

SEQ ID NO: 3192 - RNA, 18 nt, Homo Sapiens
gcacauguuuuucaagag

SEQ ID NO: 3193 - RNA, 24 nt, Homo Sapiens
cuggaccaguguugaucuguaaug

SEQ ID NO: 3194 - RNA, 26 nt, Homo Sapiens
cugggacggaacccggguuccucucg

SEQ ID NO: 3195 - RNA, 25 nt, Homo Sapiens
cuggguggcaaaguuacuacuggaa

SEQ ID NO: 3196 - RNA, 22 nt, Homo Sapiens
cugccccccaccccucaguuaa

SEQ ID NO: 3197 - RNA, 24 nt, Homo Sapiens
cugccaccacgccuggcuaggaaa

SEQ ID NO: 3198 - RNA, 22 nt, Homo Sapiens
cugcaaccuccgccucccgggu

SEQ ID NO: 3199 - RNA, 18 nt, Homo Sapiens
cugcagugaacacaugcc

SEQ ID NO: 3200 - RNA, 29 nt, Homo Sapiens
gaaacaaaaagguauuuugcuguuaccuc

SEQ ID NO: 3201 - RNA, 22 nt, Homo Sapiens
gaaacaucauuauuggcaguuu

SEQ ID NO: 3202 - RNA, 21 nt, Homo Sapiens
cuuuaaguagggauguuuagg

SEQ ID NO: 3203 - RNA, 21 nt, Homo Sapiens
ggcucacugcaaccuccgccu

SEQ ID NO: 3204 - RNA, 22 nt, Homo Sapiens
ggcucacugcaaccuccgccuc

SEQ ID NO: 3205 - RNA, 21 nt, Homo Sapiens
guacacagauggcagugccau

SEQ ID NO: 3206 - RNA, 28 nt, Homo Sapiens
ggguucaugacuuggcuguuaaagaugu

SEQ ID NO: 3207 - RNA, 23 nt, Homo Sapiens
gucucauccuucucugacucuuc

SEQ ID NO: 3208 - RNA, 20 nt, Homo Sapiens
gugcuauuauuucugguucu

SEQ ID NO: 3209 - RNA, 22 nt, Homo Sapiens
gcucacugcaaccuccgccucc

SEQ ID NO: 3210 - RNA, 20 nt, Homo Sapiens
gcucuuguugcccaggcugg

SEQ ID NO: 3211 - RNA, 19 nt, Homo Sapiens
gcugcagccaucccccuca

SEQ ID NO: 3212 - RNA, 25 nt, Homo Sapiens
gcugcuggggaggaccucaguuaac

SEQ ID NO: 3213 - RNA, 20 nt, Homo Sapiens
gcuuaagaaaacauugccau

SEQ ID NO: 3214 - RNA, 27 nt, Homo Sapiens
ggaggugggggccuucgggaggaggag

SEQ ID NO: 3215 - RNA, 23 nt, Homo Sapiens
gcccaggcugggagggcaauggc

SEQ ID NO: 3216 - RNA, 22 nt, Homo Sapiens
gccaaaacaugauugaagccuu

SEQ ID NO: 3217 - RNA, 20 nt, Homo Sapiens
gcagugccauaagcaagucu

SEQ ID NO: 3218 - RNA, 21 nt, Homo Sapiens
gcccuccucugcacucccacc

SEQ ID NO: 3219 - RNA, 24 nt, Homo Sapiens
ggcacucagucucucuucucucca

SEQ ID NO: 3220 - RNA, 21 nt, Homo Sapiens
ggcuguaacuacuuuauaacu

SEQ ID NO: 3221 - RNA, 21 nt, Homo Sapiens
gcacagcccuuaugcgguuaa

SEQ ID NO: 3222 - RNA, 23 nt, Homo Sapiens
ccgucuggcccaccaggguccuu

SEQ ID NO: 3223 - RNA, 22 nt, Homo Sapiens
cucaggcaauuagacacuuugg

SEQ ID NO: 3224 - RNA, 21 nt, Homo Sapiens
cucagucucucuucucuccag

SEQ ID NO: 3225 - RNA, 20 nt, Homo Sapiens
cuacccagacuagauguagu

SEQ ID NO: 3226 - RNA, 22 nt, Homo Sapiens
agcuguggcagaguuacaguuc

SEQ ID NO: 3227 - RNA, 22 nt, Homo Sapiens
ccagguucccucccagaggagc

SEQ ID NO: 3228 - RNA, 23 nt, Homo Sapiens
cagcugcaagguacucuggugag

SEQ ID NO: 3229 - RNA, 19 nt, Homo Sapiens
auuaucugucagcugcaag

SEQ ID NO: 3230 - RNA, 27 nt, Homo Sapiens
aguauuuuguauaauuggauucuaaua

SEQ ID NO: 3231 - RNA, 17 nt, Homo Sapiens
aggcuguaacuacuuua

SEQ ID NO: 3232 - RNA, 21 nt, Homo Sapiens
uucuccucacuguauccaggu

SEQ ID NO: 3233 - RNA, 19 nt, Homo Sapiens
uucggccccauguaucuca

SEQ ID NO: 3234 - RNA, 21 nt, Homo Sapiens
uuaccuaagauuacaaaucag

SEQ ID NO: 3235 - RNA, 22 nt, Homo Sapiens
uggugagucaccacuucagggc

SEQ ID NO: 3236 - RNA, 28 nt, Homo Sapiens
uggcucuaauucacagugcucuuucucc

SEQ ID NO: 3237 - RNA, 21 nt, Homo Sapiens
ucaggcaauuagacacuuugg

SEQ ID NO: 3238 - RNA, 24 nt, Homo Sapiens
ucucuggugcagccccuguccuca

SEQ ID NO: 3239 - RNA, 21 nt, Homo Sapiens
uggcggccgugggcuccuggg

SEQ ID NO: 3240 - RNA, 25 nt, Homo Sapiens
uggcggccgugggcuccuggggagc

SEQ ID NO: 3241 - RNA, 21 nt, Homo Sapiens
ugggggugcgggggugucaug

SEQ ID NO: 3242 - RNA, 21 nt, Homo Sapiens
uggggagccacuggggagggg

SEQ ID NO: 3243 - RNA, 21 nt, Homo Sapiens
uggggaggggguggcggccgc

SEQ ID NO: 3244 - RNA, 22 nt, Homo Sapiens
uuaucuuguugucacagggcua

SEQ ID NO: 3245 - RNA, 28 nt, Homo Sapiens
uuaucuuguugucacagggcuaacccuc

SEQ ID NO: 3246 - RNA, 23 nt, Homo Sapiens
uuggucccuuaucuuguugucac

SEQ ID NO: 3247 - RNA, 22 nt, Homo Sapiens
cagccagcagaggcagcagcac

SEQ ID NO: 3248 - RNA, 22 nt, Homo Sapiens
acccugugagaacaagccccuc

SEQ ID NO: 3249 - RNA, 22 nt, Homo Sapiens
cucagagauggucuccagguga

SEQ ID NO: 3250 - RNA, 27 nt, Homo Sapiens
cucucccugaauccagagcgcugcagu

SEQ ID NO: 3251 - RNA, 21 nt, Homo Sapiens
cccuguccucaccacucuggg

SEQ ID NO: 3252 - RNA, 19 nt, Homo Sapiens
ccucucauucugugucccu

SEQ ID NO: 3253 - RNA, 27 nt, Homo Sapiens
ccuguccucaccacucugggcuugugc

SEQ ID NO: 3254 - RNA, 32 nt, Homo Sapiens
ccuguccucaccacucugggcuugugcuguuc

SEQ ID NO: 3255 - RNA, 22 nt, Homo Sapiens
gcacagacaggcccacgugugu

SEQ ID NO: 3256 - RNA, 23 nt, Homo Sapiens
gaauccagagcgcugcagucaca

SEQ ID NO: 3257 - RNA, 21 nt, Homo Sapiens
cugggcuugugcuguucuugg

SEQ ID NO: 3258 - RNA, 23 nt, Homo Sapiens
gggguccaccugugugcaccagg

SEQ ID NO: 3259 - RNA, 23 nt, Homo Sapiens
ggggagccacuggggagggggug

SEQ ID NO: 3260 - RNA, 22 nt, Homo Sapiens
gccugaguccccaugcccugcu

SEQ ID NO: 3261 - RNA, 24 nt, Homo Sapiens
ggacaugaucuucuuuauaauucu

SEQ ID NO: 3262 - RNA, 24 nt, Homo Sapiens
ggcaacuuagagguggggagcaga

SEQ ID NO: 3263 - RNA, 22 nt, Homo Sapiens
cuuugagugcugucuccauguu

SEQ ID NO: 3264 - RNA, 23 nt, Homo Sapiens
gcaacuuagagguggggagcaga

SEQ ID NO: 3265 - RNA, 30 nt, Homo Sapiens
gauaugcuuauacacuuacacuuuaugcac

SEQ ID NO: 3266 - RNA, 22 nt, Homo Sapiens
cuccauguuugauguaucugag

SEQ ID NO: 3267 - RNA, 28 nt, Homo Sapiens
agguggggagcagagaauucucuuaucc

SEQ ID NO: 3268 - RNA, 21 nt, Homo Sapiens
caaauucugcuugcuugcuuu

SEQ ID NO: 3269 - RNA, 25 nt, Homo Sapiens
uggacaugaucuucuuuauaauucu

SEQ ID NO: 3270 - RNA, 23 nt, Homo Sapiens
uggaugaauuccaaauucugcuu

SEQ ID NO: 3271 - RNA, 26 nt, Homo Sapiens
ugauaugcuuauacacuuacacuuua

SEQ ID NO: 3272 - RNA, 24 nt, Homo Sapiens
ucucuuauccaacaucaacaucuu

SEQ ID NO: 3273 - RNA, 20 nt, Homo Sapiens
ucuaguuccugauagcuacc

SEQ ID NO: 3274 - RNA, 24 nt, Homo Sapiens
ucaguucuagcauaguaaacuacg

SEQ ID NO: 3275 - RNA, 24 nt, Homo Sapiens
ucaugacagcuacuaaccuggaga

SEQ ID NO: 3276 - RNA, 22 nt, Homo Sapiens
ucccuaucaguucuagcauagu

SEQ ID NO: 3277 - RNA, 22 nt, Homo Sapiens
uccagggcauaaaacucaaccc

SEQ ID NO: 3278 - RNA, 20 nt, Homo Sapiens
uaguaccuguaagcauuuua

SEQ ID NO: 3279 - RNA, 19 nt, Homo Sapiens
guuacuuccuuccugcccc

SEQ ID NO: 3280 - RNA, 23 nt, Homo Sapiens
guuagugggaagagcuggguuuu

SEQ ID NO: 3281 - RNA, 27 nt, Homo Sapiens
guuucacugccuuccuacccucucuaa

SEQ ID NO: 3282 - RNA, 22 nt, Homo Sapiens
uaacacaugaauuucugccaua

SEQ ID NO: 3283 - RNA, 27 nt, Homo Sapiens
ucuuccuggucauaggcucacucuuuc

SEQ ID NO: 3284 - RNA, 22 nt, Homo Sapiens
ugcuaguaccuguaagcauuuu

SEQ ID NO: 3285 - RNA, 20 nt, Homo Sapiens
uguaggaguaaagauaaaag

SEQ ID NO: 3286 - RNA, 26 nt, Homo Sapiens
ugucccugugguacccuggcagagaa

SEQ ID NO: 3287 - RNA, 27 nt, Homo Sapiens
uugaggggagaggaaaucuuaagauua

SEQ ID NO: 3288 - RNA, 27 nt, Homo Sapiens
uucaaagcucuaauagagucacagcuu

SEQ ID NO: 3289 - RNA, 23 nt, Homo Sapiens
uuaccucccuaucaguucuagca

SEQ ID NO: 3290 - RNA, 21 nt, Homo Sapiens
uguuauucucggacugugaau

SEQ ID NO: 3291 - RNA, 19 nt, Homo Sapiens
uucuacaaguaauuuugca

SEQ ID NO: 3292 - RNA, 24 nt, Homo Sapiens
uucuacaaguaauuuugcacagac

SEQ ID NO: 3293 - RNA, 27 nt, Homo Sapiens
uucuacaaguaauuuugcacagacauc

SEQ ID NO: 3294 - RNA, 26 nt, Homo Sapiens
uucauugucucuaucugaaccacccu

SEQ ID NO: 3295 - RNA, 21 nt, Homo Sapiens
uuccuacccucucuaauggcc

SEQ ID NO: 3296 - RNA, 23 nt, Homo Sapiens
uuccuguucaugacagcuacuaa

SEQ ID NO: 3297 - RNA, 23 nt, Homo Sapiens
auucuccaacccaaaguauucuu

SEQ ID NO: 3298 - RNA, 21 nt, Homo Sapiens
auguugggaaaaacuggcuuu

SEQ ID NO: 3299 - RNA, 25 nt, Homo Sapiens
augggaaagggugaggacuucacaa

SEQ ID NO: 3300 - RNA, 22 nt, Homo Sapiens
caccacccagacuugggggcag

SEQ ID NO: 3301 - RNA, 22 nt, Homo Sapiens
caccauuccuuuaaauucucca

SEQ ID NO: 3302 - RNA, 27 nt, Homo Sapiens
cacucacugcauuuggggccuuuccca

SEQ ID NO: 3303 - RNA, 22 nt, Homo Sapiens
cacugcacuuggugcugcuuug

SEQ ID NO: 3304 - RNA, 24 nt, Homo Sapiens
agggugaggacuucacaauguugg

SEQ ID NO: 3305 - RNA, 28 nt, Homo Sapiens
agggagcugaggccauucccuguaggag

SEQ ID NO: 3306 - RNA, 22 nt, Homo Sapiens
auaauuucuacccauguuggga

SEQ ID NO: 3307 - RNA, 23 nt, Homo Sapiens
aucuuaagauuacaagauaaaaa

SEQ ID NO: 3308 - RNA, 23 nt, Homo Sapiens
ccacugcacuuggugcugcuuug

SEQ ID NO: 3309 - RNA, 25 nt, Homo Sapiens
ccacauuuugcuuuauaauuucuac

SEQ ID NO: 3310 - RNA, 26 nt, Homo Sapiens
ccacccagacuugggggcaggcgcca

SEQ ID NO: 3311 - RNA, 29 nt, Homo Sapiens
ccaaguucauuaccucccuaucaguucua

SEQ ID NO: 3312 - RNA, 21 nt, Homo Sapiens
ccaagcuuguuucccugcugg

SEQ ID NO: 3313 - RNA, 22 nt, Homo Sapiens
ccccaaaucuuccucuggagcu

SEQ ID NO: 3314 - RNA, 22 nt, Homo Sapiens
accaugaagugaaaaugccaca

SEQ ID NO: 3315 - RNA, 22 nt, Homo Sapiens
acucacugcauuuggggccuuu

SEQ ID NO: 3316 - RNA, 26 nt, Homo Sapiens
acucacugcauuuggggccuuuccca

SEQ ID NO: 3317 - RNA, 20 nt, Homo Sapiens
agccucuccccugcucccgu

SEQ ID NO: 3318 - RNA, 21 nt, Homo Sapiens
agcccggacccgggggcuggc

SEQ ID NO: 3319 - RNA, 22 nt, Homo Sapiens
agacaguggcagcaaaggaaga

SEQ ID NO: 3320 - RNA, 21 nt, Homo Sapiens
aaccaacugccuuaaccuucu

SEQ ID NO: 3321 - RNA, 21 nt, Homo Sapiens
aaccaauaaaacaagaauacu

SEQ ID NO: 3322 - RNA, 19 nt, Homo Sapiens
aaguauucuucuuuucuua

SEQ ID NO: 3323 - RNA, 26 nt, Homo Sapiens
ccuucaguaucaaggcugccuggaga

SEQ ID NO: 3324 - RNA, 25 nt, Homo Sapiens
ccucuccugagaagccaccagcacc

SEQ ID NO: 3325 - RNA, 26 nt, Homo Sapiens
ccugccuggauuucuuccuauuaggc

SEQ ID NO: 3326 - RNA, 22 nt, Homo Sapiens
ccggaucccagccucuccccug

SEQ ID NO: 3327 - RNA, 23 nt, Homo Sapiens
gaugggaagggcuuaucuagcca

SEQ ID NO: 3328 - RNA, 22 nt, Homo Sapiens
gauuagcuagacuaggagacca

SEQ ID NO: 3329 - RNA, 21 nt, Homo Sapiens
gaccacaccuccgugguucac

SEQ ID NO: 3330 - RNA, 26 nt, Homo Sapiens
gaagagaccaagcuuguuucccugcu

SEQ ID NO: 3331 - RNA, 21 nt, Homo Sapiens
cuuuucugugguugcagccug

SEQ ID NO: 3332 - RNA, 22 nt, Homo Sapiens
cuuccuacccucucuaauggcc

SEQ ID NO: 3333 - RNA, 22 nt, Homo Sapiens
cuuaacaacagcuucuugcuug

SEQ ID NO: 3334 - RNA, 23 nt, Homo Sapiens
cuguauuuuuaaauucugcuccu

SEQ ID NO: 3335 - RNA, 19 nt, Homo Sapiens
cugagucaguuuuuuaucu

SEQ ID NO: 3336 - RNA, 27 nt, Homo Sapiens
ggcagagaagagaccaagcuuguuucc

SEQ ID NO: 3337 - RNA, 21 nt, Homo Sapiens
gggcuccggaucccagccucu

SEQ ID NO: 3338 - RNA, 22 nt, Homo Sapiens
gggaaagggugaggacuucaca

SEQ ID NO: 3339 - RNA, 26 nt, Homo Sapiens
gucuccauuuuucccaggacaggaaa

SEQ ID NO: 3340 - RNA, 22 nt, Homo Sapiens
gucaguaggagaggaugcacag

SEQ ID NO: 3341 - RNA, 24 nt, Homo Sapiens
gucccauucuccacucacugcauu

SEQ ID NO: 3342 - RNA, 22 nt, Homo Sapiens
ggguuccagggacuguaccugu

SEQ ID NO: 3343 - RNA, 27 nt, Homo Sapiens
ggguucucuucauucccacugcacuug

SEQ ID NO: 3344 - RNA, 21 nt, Homo Sapiens
guauuuuuaaauucugcuccu

SEQ ID NO: 3345 - RNA, 20 nt, Homo Sapiens
ggagaaggaaaaggcuggca

SEQ ID NO: 3346 - RNA, 21 nt, Homo Sapiens
ggagaagggagaacagggguc

SEQ ID NO: 3347 - RNA, 24 nt, Homo Sapiens
ggagacacagauggcaccuguggc

SEQ ID NO: 3348 - RNA, 22 nt, Homo Sapiens
ggaaagggugaggacuucacaa

SEQ ID NO: 3349 - RNA, 23 nt, Homo Sapiens
ggagagggaaauacaaggagggc

SEQ ID NO: 3350 - RNA, 21 nt, Homo Sapiens
gcuaguaccuguaagcauuuu

SEQ ID NO: 3351 - RNA, 24 nt, Homo Sapiens
gcgugugucccugugguacccugg

SEQ ID NO: 3352 - RNA, 27 nt, Homo Sapiens
gccagugcgagcccagagggcccgaag

SEQ ID NO: 3353 - RNA, 23 nt, Homo Sapiens
gccagggacggacgugggccagu

SEQ ID NO: 3354 - RNA, 17 nt, Homo Sapiens
gccagaauucacuagga

SEQ ID NO: 3355 - RNA, 22 nt, Homo Sapiens
gccuucuccccucccgcgagcc

SEQ ID NO: 3356 - RNA, 27 nt, Homo Sapiens
gccugagcccggcgaggguggggaggg

SEQ ID NO: 3357 - RNA, 30 nt, Homo Sapiens
ggugcgcgcccaucccugcccgcagccccg

SEQ ID NO: 3358 - RNA, 21 nt, Homo Sapiens
guggguuucucugugcucuga

SEQ ID NO: 3359 - RNA, 25 nt, Homo Sapiens
cuugucuuaaucguccugcugcugc

SEQ ID NO: 3360 - RNA, 24 nt, Homo Sapiens
gaugguccucacaagccucuucug

SEQ ID NO: 3361 - RNA, 22 nt, Homo Sapiens
gauggcaggagaaucagccugg

SEQ ID NO: 3362 - RNA, 24 nt, Homo Sapiens
ccgcucagucuuugagcgagccca

SEQ ID NO: 3363 - RNA, 22 nt, Homo Sapiens
ccugcugcugcugccguuccgg

SEQ ID NO: 3364 - RNA, 21 nt, Homo Sapiens
cucccagaugccuucuagauu

SEQ ID NO: 3365 - RNA, 21 nt, Homo Sapiens
cugagcccggcgagggugggg

SEQ ID NO: 3366 - RNA, 21 nt, Homo Sapiens
cgucuguggagccauccuccu

SEQ ID NO: 3367 - RNA, 27 nt, Homo Sapiens
aaccaaaacagaguggauugggcugca

SEQ ID NO: 3368 - RNA, 22 nt, Homo Sapiens
agaccuggaaccagagccacag

SEQ ID NO: 3369 - RNA, 18 nt, Homo Sapiens
agccagaauucacuagga

SEQ ID NO: 3370 - RNA, 20 nt, Homo Sapiens
agccuccuccccucccgcga

SEQ ID NO: 3371 - RNA, 25 nt, Homo Sapiens
accggcuaggcugggcgcgcccccc

SEQ ID NO: 3372 - RNA, 18 nt, Homo Sapiens
acaggaagcuuuuuguau

SEQ ID NO: 3373 - RNA, 18 nt, Homo Sapiens
accaacauaaaacaaaac

SEQ ID NO: 3374 - RNA, 27 nt, Homo Sapiens
aaugaugaguccucucuggucagacau

SEQ ID NO: 3375 - RNA, 22 nt, Homo Sapiens
cccucccgcgagccuccucccc

SEQ ID NO: 3376 - RNA, 24 nt, Homo Sapiens
cccucacccaaaagaauuaucauc

SEQ ID NO: 3377 - RNA, 19 nt, Homo Sapiens
ccaggguccugugccugga

SEQ ID NO: 3378 - RNA, 27 nt, Homo Sapiens
ccaggaagaguucuauccccaagcugg

SEQ ID NO: 3379 - RNA, 22 nt, Homo Sapiens
ccaaaacagaguggauugggcu

SEQ ID NO: 3380 - RNA, 27 nt, Homo Sapiens
caggagaaucagccuggggccugggga

SEQ ID NO: 3381 - RNA, 18 nt, Homo Sapiens
ugugccuggaugggggug

SEQ ID NO: 3382 - RNA, 22 nt, Homo Sapiens
uugcccaggguccugugccugg

SEQ ID NO: 3383 - RNA, 25 nt, Homo Sapiens
uugcccaggguccugugccuggaug

SEQ ID NO: 3384 - RNA, 26 nt, Homo Sapiens
uugcccaggguccugugccuggaugg

SEQ ID NO: 3385 - RNA, 21 nt, Homo Sapiens
uguccccgcucagucuuugag

SEQ ID NO: 3386 - RNA, 27 nt, Homo Sapiens
ucuguucugcucccagaugccuucuag

SEQ ID NO: 3387 - RNA, 27 nt, Homo Sapiens
ucugcucccagaugccuucuagauuca

SEQ ID NO: 3388 - RNA, 19 nt, Homo Sapiens
uaauugccuuugagguuau

SEQ ID NO: 3389 - RNA, 23 nt, Homo Sapiens
guucucuucucucuucaaucucu

SEQ ID NO: 3390 - RNA, 20 nt, Homo Sapiens
uaggaggucaucaaccgaug

SEQ ID NO: 3391 - RNA, 26 nt, Homo Sapiens
ucaaugaugaguccucucuggucaga

SEQ ID NO: 3392 - RNA, 26 nt, Homo Sapiens
ucucuguucugcucccagaugccuuc

SEQ ID NO: 3393 - RNA, 22 nt, Homo Sapiens
ucaccaucuggaagaagauggg

SEQ ID NO: 3394 - RNA, 23 nt, Homo Sapiens
uguguuuuuccuccauaaauuau

SEQ ID NO: 3395 - RNA, 20 nt, Homo Sapiens
aucuacccugcugaccuccc

SEQ ID NO: 3396 - RNA, 26 nt, Homo Sapiens
agggguggggauugggggacaugggc

SEQ ID NO: 3397 - RNA, 26 nt, Homo Sapiens
agugccuucugcccucccuggagccu

SEQ ID NO: 3398 - RNA, 21 nt, Homo Sapiens
ccuucugcccucccuggagcc

SEQ ID NO: 3399 - RNA, 22 nt, Homo Sapiens
gauucaucuacccugcugaccu

SEQ ID NO: 3400 - RNA, 20 nt, Homo Sapiens
gacccucugacccuagcucu

SEQ ID NO: 3401 - RNA, 25 nt, Homo Sapiens
ggucuugaggggguaauaaaccucc

SEQ ID NO: 3402 - RNA, 22 nt, Homo Sapiens
ggccuccucuccuacuuuggga

SEQ ID NO: 3403 - RNA, 21 nt, Homo Sapiens
gcauuuuucuuacuuuuguaa

SEQ ID NO: 3404 - RNA, 27 nt, Homo Sapiens
gccugguucaauuucuuucuuuccuua

SEQ ID NO: 3405 - RNA, 29 nt, Homo Sapiens
guccaauuuacaggcuggagcagcagcug

SEQ ID NO: 3406 - RNA, 23 nt, Homo Sapiens
gagauauuaaaauaagcacagaa

SEQ ID NO: 3407 - RNA, 31 nt, Homo Sapiens
cuccuugcaaacuuuaccaucuuuguugcag

SEQ ID NO: 3408 - RNA, 25 nt, Homo Sapiens
agauauuaaaauaagcacagaaaau

SEQ ID NO: 3409 - RNA, 22 nt, Homo Sapiens
uuauguagcugaaacaaaaaug

SEQ ID NO: 3410 - RNA, 27 nt, Homo Sapiens
uuauguagcugaaacaaaaaugccaga

SEQ ID NO: 3411 - RNA, 22 nt, Homo Sapiens
uaguauuuuaccuagcauuuca

SEQ ID NO: 3412 - RNA, 27 nt, Homo Sapiens
uccuagaguagaguggagggagggugg

SEQ ID NO: 3413 - RNA, 21 nt, Homo Sapiens
ucaucucuaacagcucaggau

SEQ ID NO: 3414 - RNA, 27 nt, Homo Sapiens
uuagcauuuuaauuagauguaauuguu

SEQ ID NO: 3415 - RNA, 19 nt, Homo Sapiens
uuccagucuccaccaggaa

SEQ ID NO: 3416 - RNA, 22 nt, Homo Sapiens
ccuuguuccuagaguagagugg

SEQ ID NO: 3417 - RNA, 26 nt, Homo Sapiens
gagggaggguggccuaagaguugagc

SEQ ID NO: 3418 - RNA, 25 nt, Homo Sapiens
gcccuccagcucuuuccuccuucca

SEQ ID NO: 3419 - RNA, 26 nt, Homo Sapiens
gccaaaguuaugcaagggacugugug

SEQ ID NO: 3420 - RNA, 18 nt, Homo Sapiens
gcauggucaaaggcucaa

SEQ ID NO: 3421 - RNA, 20 nt, Homo Sapiens
gucaaugacaguuucuuuuu

SEQ ID NO: 3422 - RNA, 24 nt, Homo Sapiens
ggcauggucaaaggcucaaaccuu

SEQ ID NO: 3423 - RNA, 21 nt, Homo Sapiens
gaauuuuuaugauauuccccc

SEQ ID NO: 3424 - RNA, 20 nt, Homo Sapiens
cuuccagucagguaguugca

SEQ ID NO: 3425 - RNA, 23 nt, Homo Sapiens
ccuguuccaugaaggcagagcca

SEQ ID NO: 3426 - RNA, 23 nt, Homo Sapiens
ccugccucuucccccauucucau

SEQ ID NO: 3427 - RNA, 21 nt, Homo Sapiens
cuccaggccucagcaggugcg

SEQ ID NO: 3428 - RNA, 23 nt, Homo Sapiens
cucucauuuugaccuacucucau

SEQ ID NO: 3429 - RNA, 20 nt, Homo Sapiens
cuaccucaaacuuccaguca

SEQ ID NO: 3430 - RNA, 27 nt, Homo Sapiens
cucagcaggugcggagccgucacugca

SEQ ID NO: 3431 - RNA, 23 nt, Homo Sapiens
agcacucagcccgggaggcaggc

SEQ ID NO: 3432 - RNA, 22 nt, Homo Sapiens
agccuguuccaugaaggcagag

SEQ ID NO: 3433 - RNA, 24 nt, Homo Sapiens
aggcaaugauuguuaauuuacagc

SEQ ID NO: 3434 - RNA, 18 nt, Homo Sapiens
acagcccauuucuccaua

SEQ ID NO: 3435 - RNA, 21 nt, Homo Sapiens
accuacucucaugcugcagag

SEQ ID NO: 3436 - RNA, 21 nt, Homo Sapiens
aaacuguugauuauuagccag

SEQ ID NO: 3437 - RNA, 22 nt, Homo Sapiens
aaagcaauaaaugaaugggcug

SEQ ID NO: 3438 - RNA, 17 nt, Homo Sapiens
cagcccauuucuccaua

SEQ ID NO: 3439 - RNA, 21 nt, Homo Sapiens
ccauuuaucugggauuauggu

SEQ ID NO: 3440 - RNA, 23 nt, Homo Sapiens
uccaugaaggcagagccauggac

SEQ ID NO: 3441 - RNA, 24 nt, Homo Sapiens
uauccguggccacagcugguuggc

SEQ ID NO: 3442 - RNA, 23 nt, Homo Sapiens
uaacugcauuuuagaccauuuau

SEQ ID NO: 3443 - RNA, 20 nt, Homo Sapiens
ugucaaugacaguuucuuuu

SEQ ID NO: 3444 - RNA, 26 nt, Homo Sapiens
ugguuggcgucgccuugaaaucccag

SEQ ID NO: 3445 - RNA, 20 nt, Homo Sapiens
ugcugccagaaccuugggga

SEQ ID NO: 3446 - RNA, 27 nt, Homo Sapiens
ucugcuugauuuuugccucuuccaguc

SEQ ID NO: 3447 - RNA, 20 nt, Homo Sapiens
ugccuagacccggcgcagca

SEQ ID NO: 3448 - RNA, 21 nt, Homo Sapiens
uacagagucuggugaagcuca

SEQ ID NO: 3449 - RNA, 27 nt, Homo Sapiens
ucccugccucucaucaacugaaugagg

SEQ ID NO: 3450 - RNA, 16 nt, Homo Sapiens
uccaacuaaugccuua

SEQ ID NO: 3451 - RNA, 23 nt, Homo Sapiens
uucagcaaacucuuuucccacug

SEQ ID NO: 3452 - RNA, 23 nt, Homo Sapiens
uuagaaaacauaaucuucugccu

SEQ ID NO: 3453 - RNA, 24 nt, Homo Sapiens
uuucagcaaacucuuuucccacug

SEQ ID NO: 3454 - RNA, 22 nt, Homo Sapiens
uuuucagcaaacucuuuuccca

SEQ ID NO: 3455 - RNA, 21 nt, Homo Sapiens
cccugcucaguaaagcacuug

SEQ ID NO: 3456 - RNA, 20 nt, Homo Sapiens
cagcccagggaaaccuccuc

SEQ ID NO: 3457 - RNA, 22 nt, Homo Sapiens
cagcaaacucuuuucccacugu

SEQ ID NO: 3458 - RNA, 20 nt, Homo Sapiens
ccaacaaccucaacugccua

SEQ ID NO: 3459 - RNA, 20 nt, Homo Sapiens
auacaagaucuuccuuccuc

SEQ ID NO: 3460 - RNA, 22 nt, Homo Sapiens
aaccaacaaccucaacugccua

SEQ ID NO: 3461 - RNA, 21 nt, Homo Sapiens
aaccucaacugccuacuccaa

SEQ ID NO: 3462 - RNA, 23 nt, Homo Sapiens
aaccuguuaccuacuuugacuuu

SEQ ID NO: 3463 - RNA, 20 nt, Homo Sapiens
aacucugcuugauuuuugcc

SEQ ID NO: 3464 - RNA, 20 nt, Homo Sapiens
acagagucuggugaagcuca

SEQ ID NO: 3465 - RNA, 21 nt, Homo Sapiens
accaacaaccucaacugccua

SEQ ID NO: 3466 - RNA, 21 nt, Homo Sapiens
agccugcacaauaaaaauguu

SEQ ID NO: 3467 - RNA, 24 nt, Homo Sapiens
agaugggggaggaggcaguaauaa

SEQ ID NO: 3468 - RNA, 21 nt, Homo Sapiens
agaaaacauaaucuucugccu

SEQ ID NO: 3469 - RNA, 22 nt, Homo Sapiens
ccucccagccaccgccccccuc

SEQ ID NO: 3470 - RNA, 20 nt, Homo Sapiens
ccuuaaagcacagcccaggg

SEQ ID NO: 3471 - RNA, 23 nt, Homo Sapiens
ccuuuuaauuuuccuggugccaa

SEQ ID NO: 3472 - RNA, 22 nt, Homo Sapiens
cuuuuaaacuguguacauaacu

SEQ ID NO: 3473 - RNA, 22 nt, Homo Sapiens
cugccagaaccuuggggaugug

SEQ ID NO: 3474 - RNA, 24 nt, Homo Sapiens
cugccuacuccaaaauguugguca

SEQ ID NO: 3475 - RNA, 21 nt, Homo Sapiens
gaaguauuuugcuggaauaag

SEQ ID NO: 3476 - RNA, 22 nt, Homo Sapiens
gaacucaaacugaggaauuuca

SEQ ID NO: 3477 - RNA, 21 nt, Homo Sapiens
gaggggcuguaaaauggaggc

SEQ ID NO: 3478 - RNA, 27 nt, Homo Sapiens
gaggcucccucccagccaccgcccccc

SEQ ID NO: 3479 - RNA, 26 nt, Homo Sapiens
gauugcugaaauuuuauaugcuuacu

SEQ ID NO: 3480 - RNA, 21 nt, Homo Sapiens
ggucauuuuauguuaagggaa

SEQ ID NO: 3481 - RNA, 23 nt, Homo Sapiens
gccuccaaggaggggcuguaaaa

SEQ ID NO: 3482 - RNA, 23 nt, Homo Sapiens
gcuuuuuauuccuccugcucaua

SEQ ID NO: 3483 - RNA, 24 nt, Homo Sapiens
gcugccugguauauccaaaagcuu

SEQ ID NO: 3484 - RNA, 27 nt, Homo Sapiens
gcacuguucugauuauguaagcauuug

SEQ ID NO: 3485 - RNA, 32 nt, Homo Sapiens
gcacuguucugauuauguaagcauuuguacau

SEQ ID NO: 3486 - RNA, 20 nt, Homo Sapiens
gauugggauacuguaauacu

SEQ ID NO: 3487 - RNA, 22 nt, Homo Sapiens
cuuuggaaauaaaagauaaaag

SEQ ID NO: 3488 - RNA, 20 nt, Homo Sapiens
cuuggaccccaggucuggag

SEQ ID NO: 3489 - RNA, 24 nt, Homo Sapiens
cgggacggccgggcugggagcugg

SEQ ID NO: 3490 - RNA, 21 nt, Homo Sapiens
acaguaaguugacaccacuua

SEQ ID NO: 3491 - RNA, 23 nt, Homo Sapiens
accacuguucuguucauuuccua

SEQ ID NO: 3492 - RNA, 20 nt, Homo Sapiens
acuguaauacuucuuuguua

SEQ ID NO: 3493 - RNA, 25 nt, Homo Sapiens
aacauaaaagcaccacuguucuguu

SEQ ID NO: 3494 - RNA, 26 nt, Homo Sapiens
aacauaaaagcaccacuguucuguuc

SEQ ID NO: 3495 - RNA, 24 nt, Homo Sapiens
aagauguuucauuuuacuguauau

SEQ ID NO: 3496 - RNA, 19 nt, Homo Sapiens
augauccuggaaauugcag

SEQ ID NO: 3497 - RNA, 26 nt, Homo Sapiens
aguauacauuuuauaaugaugaacuu

SEQ ID NO: 3498 - RNA, 25 nt, Homo Sapiens
agggacauuucuauaaaaauacuac

SEQ ID NO: 3499 - RNA, 21 nt, Homo Sapiens
cagauugcuuaaaagcauuuu

SEQ ID NO: 3500 - RNA, 27 nt, Homo Sapiens
cagauugcuuaaaagcauuuuuauuau

SEQ ID NO: 3501 - RNA, 23 nt, Homo Sapiens
cccauuaaaaaugagauuucuua

SEQ ID NO: 3502 - RNA, 21 nt, Homo Sapiens
uacuguaauacuucuuuguua

SEQ ID NO: 3503 - RNA, 23 nt, Homo Sapiens
ucagauugcuuaaaagcauuuuu

SEQ ID NO: 3504 - RNA, 21 nt, Homo Sapiens
ugcuccugccacuagguuuca

SEQ ID NO: 3505 - RNA, 27 nt, Homo Sapiens
uggggaagugcggugacugggaaaugc

SEQ ID NO: 3506 - RNA, 20 nt, Homo Sapiens
ccagcgcacagccugggcag

SEQ ID NO: 3507 - RNA, 26 nt, Homo Sapiens
caucccugcaccaggacucaccaaga

SEQ ID NO: 3508 - RNA, 27 nt, Homo Sapiens
caagacgcccauccuggaaaagguccc

SEQ ID NO: 3509 - RNA, 26 nt, Homo Sapiens
aggcagcagagccgaggagagcaggu

SEQ ID NO: 3510 - RNA, 25 nt, Homo Sapiens
cgcgucaggcccagcgcacagccug

SEQ ID NO: 3511 - RNA, 24 nt, Homo Sapiens
gcacagccugggcagcucagccug

SEQ ID NO: 3512 - RNA, 21 nt, Homo Sapiens
gagcuaggggcaggaggcaug

SEQ ID NO: 3513 - RNA, 23 nt, Homo Sapiens
gagaaaggaguaggagccuagca

SEQ ID NO: 3514 - RNA, 25 nt, Homo Sapiens
gccucaaggggugcggcccucucag

SEQ ID NO: 3515 - RNA, 24 nt, Homo Sapiens
gcgucaggcccagcgcacagccug

SEQ ID NO: 3516 - RNA, 27 nt, Homo Sapiens
gcucagccugucagcugagcacgggcg

SEQ ID NO: 3517 - RNA, 18 nt, Homo Sapiens
gcuuugagaaaggaguag

SEQ ID NO: 3518 - RNA, 20 nt, Homo Sapiens
ggugacugggaaaugcugag

SEQ ID NO: 3519 - RNA, 19 nt, Homo Sapiens
guccgaccucuggaaaugu

SEQ ID NO: 3520 - RNA, 21 nt, Homo Sapiens
ggcucacacccccgcccacac

SEQ ID NO: 3521 - RNA, 25 nt, Homo Sapiens
cgcccagccucuccccgcucuggau

SEQ ID NO: 3522 - RNA, 27 nt, Homo Sapiens
ccuuacgggggcaucuugaguccagcu

SEQ ID NO: 3523 - RNA, 24 nt, Homo Sapiens
agccucuccccgcucuggauccug

SEQ ID NO: 3524 - RNA, 16 nt, Homo Sapiens
agaacagaauugcucc

SEQ ID NO: 3525 - RNA, 19 nt, Homo Sapiens
accgcaaaaagcaccggga

SEQ ID NO: 3526 - RNA, 22 nt, Homo Sapiens
aaccaggccccagccuccaggc

SEQ ID NO: 3527 - RNA, 24 nt, Homo Sapiens
cccagccucuccccgcucuggauc

SEQ ID NO: 3528 - RNA, 21 nt, Homo Sapiens
ccccgcucuggauccugcacu

SEQ ID NO: 3529 - RNA, 21 nt, Homo Sapiens
uccaggcccccaacuccgccc

SEQ ID NO: 3530 - RNA, 24 nt, Homo Sapiens
ucucucuuccuugcuuucucuucu

SEQ ID NO: 3531 - RNA, 19 nt, Homo Sapiens
guugauuuaaacucuuaga

SEQ ID NO: 3532 - RNA, 26 nt, Homo Sapiens
uggcuaacuuuuauuaucuucuauau

SEQ ID NO: 3533 - RNA, 26 nt, Homo Sapiens
uggagaucuuaagauuccauuuugga

SEQ ID NO: 3534 - RNA, 22 nt, Homo Sapiens
ucugaacuuuggaagcugggga

SEQ ID NO: 3535 - RNA, 21 nt, Homo Sapiens
uugaucaugaaucacugcacc

SEQ ID NO: 3536 - RNA, 22 nt, Homo Sapiens
uuuucuuucuuuuuucucugac

SEQ ID NO: 3537 - RNA, 21 nt, Homo Sapiens
cagguauuuucaucaaguagc

SEQ ID NO: 3538 - RNA, 26 nt, Homo Sapiens
cagacucuuuaguugauuuaaacucu

SEQ ID NO: 3539 - RNA, 23 nt, Homo Sapiens
agucccuucucucuuccuugcuu

SEQ ID NO: 3540 - RNA, 25 nt, Homo Sapiens
agggugaggcccacucuguuccuac

SEQ ID NO: 3541 - RNA, 22 nt, Homo Sapiens
aguaauacagccugguuuucaa

SEQ ID NO: 3542 - RNA, 21 nt, Homo Sapiens
aguugaguuaagggauggcuu

SEQ ID NO: 3543 - RNA, 27 nt, Homo Sapiens
aacaacaagaaaauguacaguuagucc

SEQ ID NO: 3544 - RNA, 22 nt, Homo Sapiens
aaacccagcugacuuguuuccu

SEQ ID NO: 3545 - RNA, 20 nt, Homo Sapiens
acugaguuugaacacagauc

SEQ ID NO: 3546 - RNA, 20 nt, Homo Sapiens
aaucacugcaccucuuuguc

SEQ ID NO: 3547 - RNA, 24 nt, Homo Sapiens
agacaacaggcauuuucuuucuuu

SEQ ID NO: 3548 - RNA, 18 nt, Homo Sapiens
ccuucucucuuccuugcu

SEQ ID NO: 3549 - RNA, 21 nt, Homo Sapiens
cugaccaccugcagccuguug

SEQ ID NO: 3550 - RNA, 21 nt, Homo Sapiens
cugaacuuuggaagcugggga

SEQ ID NO: 3551 - RNA, 18 nt, Homo Sapiens
gagaaaacaggcucacag

SEQ ID NO: 3552 - RNA, 26 nt, Homo Sapiens
cuggaaaacagcugcuguuagauguc

SEQ ID NO: 3553 - RNA, 23 nt, Homo Sapiens
cugcaccucuuugucacagggug

SEQ ID NO: 3554 - RNA, 21 nt, Homo Sapiens
ggcggugaggagggcagcugg

SEQ ID NO: 3555 - RNA, 23 nt, Homo Sapiens
gucccuucucucuuccuugcuuu

SEQ ID NO: 3556 - RNA, 22 nt, Homo Sapiens
ggggugugauuugugugcgugc

SEQ ID NO: 3557 - RNA, 24 nt, Homo Sapiens
ggacuuagucaugaggagagggug

SEQ ID NO: 3558 - RNA, 21 nt, Homo Sapiens
gcauacaaguuuagccugggg

SEQ ID NO: 3559 - RNA, 22 nt, Homo Sapiens
gcaguguaacccaagcauuugu

SEQ ID NO: 3560 - RNA, 27 nt, Homo Sapiens
gcaguguaacccaagcauuuguggaca

SEQ ID NO: 3561 - RNA, 19 nt, Homo Sapiens
gccacugccaccugccucc

SEQ ID NO: 3562 - RNA, 24 nt, Homo Sapiens
gcccgaccuggggcugagugcaga

SEQ ID NO: 3563 - RNA, 26 nt, Homo Sapiens
gcugccucuaccggcuggcggcugua

SEQ ID NO: 3564 - RNA, 23 nt, Homo Sapiens
ggugaagccucugggcuuccuga

SEQ ID NO: 3565 - RNA, 27 nt, Homo Sapiens
ggugaagccucugggcuuccugaagcc

SEQ ID NO: 3566 - RNA, 27 nt, Homo Sapiens
ggcccgaccuggggcugagugcagagg

SEQ ID NO: 3567 - RNA, 22 nt, Homo Sapiens
ggcuguaacucagcgaccuugg

SEQ ID NO: 3568 - RNA, 20 nt, Homo Sapiens
cggcccagagggugggcgcg

SEQ ID NO: 3569 - RNA, 25 nt, Homo Sapiens
ccgaugccaccacagccaucgccac

SEQ ID NO: 3570 - RNA, 22 nt, Homo Sapiens
agcaggagacuggcaagagcuc

SEQ ID NO: 3571 - RNA, 27 nt, Homo Sapiens
aggggccagggugugagguuucaccuc

SEQ ID NO: 3572 - RNA, 24 nt, Homo Sapiens
cagaggcugagcaggacguuaggc

SEQ ID NO: 3573 - RNA, 22 nt, Homo Sapiens
cagggugugagguuucaccucc

SEQ ID NO: 3574 - RNA, 21 nt, Homo Sapiens
caggaccuggagacaggauug

SEQ ID NO: 3575 - RNA, 22 nt, Homo Sapiens
ccaaugccacagccaagcccac

SEQ ID NO: 3576 - RNA, 27 nt, Homo Sapiens
ccccugccacugccacaacccccgaug

SEQ ID NO: 3577 - RNA, 23 nt, Homo Sapiens
cccgcugaaucuuggcucuuguc

SEQ ID NO: 3578 - RNA, 25 nt, Homo Sapiens
cccugccacugccacaacccccgau

SEQ ID NO: 3579 - RNA, 21 nt, Homo Sapiens
cccuccagagcaggagacugg

SEQ ID NO: 3580 - RNA, 21 nt, Homo Sapiens
ucucaccagcucagccccggc

SEQ ID NO: 3581 - RNA, 24 nt, Homo Sapiens
uccuccagggggccugcaggcccc

SEQ ID NO: 3582 - RNA, 27 nt, Homo Sapiens
uccuccagggggccugcaggccccagc

SEQ ID NO: 3583 - RNA, 22 nt, Homo Sapiens
ucgccacugccaccugccuccc

SEQ ID NO: 3584 - RNA, 25 nt, Homo Sapiens
ucccaggaccuggagacaggauugu

SEQ ID NO: 3585 - RNA, 22 nt, Homo Sapiens
uagagggagagagggagagagc

SEQ ID NO: 3586 - RNA, 22 nt, Homo Sapiens
uuugaaacaacuuucucuugua

SEQ ID NO: 3587 - RNA, 23 nt, Homo Sapiens
auagagggagagagggagagagc

SEQ ID NO: 3588 - RNA, 20 nt, Homo Sapiens
acagaagucacucaauuguu

SEQ ID NO: 3589 - RNA, 20 nt, Homo Sapiens
gagggagagagggagagagc

SEQ ID NO: 3590 - RNA, 21 nt, Homo Sapiens
gggagagagggagagagccua

SEQ ID NO: 3591 - RNA, 22 nt, Homo Sapiens
gggagagagggagagagccuau

SEQ ID NO: 3592 - RNA, 27 nt, Homo Sapiens
gggagagagggagagagccuauacccc

SEQ ID NO: 3593 - RNA, 24 nt, Homo Sapiens
gcugcucuuaugccauuuguuuau

SEQ ID NO: 3594 - RNA, 22 nt, Homo Sapiens
accccucacacucaccuagcca

SEQ ID NO: 3595 - RNA, 26 nt, Homo Sapiens
ucacacucaccuagccaccauggaca

SEQ ID NO: 3596 - RNA, 14 nt, Homo Sapiens
ugcccuuucuugaa

SEQ ID NO: 3597 - RNA, 19 nt, Homo Sapiens
ugcaguugggcaaggucag

SEQ ID NO: 3598 - RNA, 23 nt, Homo Sapiens
ugacaacuaaacaaggcauucag

SEQ ID NO: 3599 - RNA, 22 nt, Homo Sapiens
uggauuuccaguuuuucuuuac

SEQ ID NO: 3600 - RNA, 25 nt, Homo Sapiens
ugucaacaaagugcuuuuucacugc

SEQ ID NO: 3601 - RNA, 20 nt, Homo Sapiens
uaggcuucagguugcauugg

SEQ ID NO: 3602 - RNA, 21 nt, Homo Sapiens
guuaacuuggaaaucaguaga

SEQ ID NO: 3603 - RNA, 22 nt, Homo Sapiens
uaaagaagaaaagcgcguugug

SEQ ID NO: 3604 - RNA, 24 nt, Homo Sapiens
uuguguauauuacaccaaugccgc

SEQ ID NO: 3605 - RNA, 20 nt, Homo Sapiens
uuaacuuggaaaucaguaga

SEQ ID NO: 3606 - RNA, 24 nt, Homo Sapiens
acagaauaguuuacacacugugug

SEQ ID NO: 3607 - RNA, 23 nt, Homo Sapiens
acaaagugcuuuuucacugccua

SEQ ID NO: 3608 - RNA, 23 nt, Homo Sapiens
acaaaagcggaagaugcugcagu

SEQ ID NO: 3609 - RNA, 32 nt, Homo Sapiens
gcucagacaacaaaagcggaagaugcugcagu

SEQ ID NO: 3610 - RNA, 26 nt, Homo Sapiens
gccucccccgacuccuggguguggga

SEQ ID NO: 3611 - RNA, 25 nt, Homo Sapiens
gcguaaggguuaucguuaagcacaa

SEQ ID NO: 3612 - RNA, 21 nt, Homo Sapiens
gcauucagcaguuucugacaa

SEQ ID NO: 3613 - RNA, 27 nt, Homo Sapiens
ggcucagacaacaaaagcggaagaugc

SEQ ID NO: 3614 - RNA, 23 nt, Homo Sapiens
gugacaacuaaacaaggcauuca

SEQ ID NO: 3615 - RNA, 23 nt, Homo Sapiens
gacggcuucucacgcuuuguuua

SEQ ID NO: 3616 - RNA, 20 nt, Homo Sapiens
cugggugugggagcagggca

SEQ ID NO: 3617 - RNA, 19 nt, Homo Sapiens
cugguucccaccucagccu

SEQ ID NO: 3618 - RNA, 19 nt, Homo Sapiens
cugggcuggugugcagugg

SEQ ID NO: 3619 - RNA, 28 nt, Homo Sapiens
gcacagagcguccuucccccuguagacu

SEQ ID NO: 3620 - RNA, 23 nt, Homo Sapiens
ccgcuccgcugcgcgcaggcugg

SEQ ID NO: 3621 - RNA, 31 nt, Homo Sapiens
ccggcaaccgcuccggcaacgccaaccgcuc

SEQ ID NO: 3622 - RNA, 26 nt, Homo Sapiens
cgcgcaggcugggcugcaggcucucg

SEQ ID NO: 3623 - RNA, 21 nt, Homo Sapiens
cuccaagcaaguagcuuucca

SEQ ID NO: 3624 - RNA, 21 nt, Homo Sapiens
gggcuggugugcaguggugcg

SEQ ID NO: 3625 - RNA, 23 nt, Homo Sapiens
gggcuggugugcaguggugcgac

SEQ ID NO: 3626 - RNA, 21 nt, Homo Sapiens
gcgcugggcuggugugcagug

SEQ ID NO: 3627 - RNA, 20 nt, Homo Sapiens
gccugugguuacagugcaga

SEQ ID NO: 3628 - RNA, 20 nt, Homo Sapiens
gcgcaggcugggcugcaggc

SEQ ID NO: 3629 - RNA, 22 nt, Homo Sapiens
gcugggcugcaggcucucggcu

SEQ ID NO: 3630 - RNA, 21 nt, Homo Sapiens
agccugugguuacagugcaga

SEQ ID NO: 3631 - RNA, 22 nt, Homo Sapiens
agcgcugggcuggugugcagug

SEQ ID NO: 3632 - RNA, 23 nt, Homo Sapiens
agcgcugggcuggugugcagugg

SEQ ID NO: 3633 - RNA, 27 nt, Homo Sapiens
agcgcugggcuggugugcaguggugcg

SEQ ID NO: 3634 - RNA, 20 nt, Homo Sapiens
agccucccgaguaguggauc

SEQ ID NO: 3635 - RNA, 21 nt, Homo Sapiens
aaccucucugaucuugugcuc

SEQ ID NO: 3636 - RNA, 29 nt, Homo Sapiens
aguuugcaaugucacaaccucucugaucu

SEQ ID NO: 3637 - RNA, 22 nt, Homo Sapiens
cacaaccucucugaucuugugc

SEQ ID NO: 3638 - RNA, 27 nt, Homo Sapiens
cacaaccucucugaucuugugcucagc

SEQ ID NO: 3639 - RNA, 22 nt, Homo Sapiens
caaccucucugaucuugugcuc

SEQ ID NO: 3640 - RNA, 25 nt, Homo Sapiens
cccagccugugguuacagugcagac

SEQ ID NO: 3641 - RNA, 26 nt, Homo Sapiens
cccagccugugguuacagugcagaca

SEQ ID NO: 3642 - RNA, 23 nt, Homo Sapiens
cagcgcugggcuggugugcagug

SEQ ID NO: 3643 - RNA, 22 nt, Homo Sapiens
uucacguaagauacaaguuuca

SEQ ID NO: 3644 - RNA, 26 nt, Homo Sapiens
ugugagccaccgcugccagcacagag

SEQ ID NO: 3645 - RNA, 22 nt, Homo Sapiens
ugggcuggugugcaguggugcg

SEQ ID NO: 3646 - RNA, 26 nt, Homo Sapiens
ugcaaugucacaaccucucugaucuu

SEQ ID NO: 3647 - RNA, 19 nt, Homo Sapiens
ucucggggacacaggccag

SEQ ID NO: 3648 - RNA, 27 nt, Homo Sapiens
ccagcuccacaguguugccagagccuu

SEQ ID NO: 3649 - RNA, 26 nt, Homo Sapiens
cucggggacacaggccagcuccacag

SEQ ID NO: 3650 - RNA, 28 nt, Homo Sapiens
gacacaggccagcuccacaguguugcca

SEQ ID NO: 3651 - RNA, 21 nt, Homo Sapiens
gcacccuagaggacuagggua

SEQ ID NO: 3652 - RNA, 19 nt, Homo Sapiens
cuuccacgauggugcagug

SEQ ID NO: 3653 - RNA, 22 nt, Homo Sapiens
cuuccuacuuugcuucucucca

SEQ ID NO: 3654 - RNA, 16 nt, Homo Sapiens
cuucccuucuuugcac

SEQ ID NO: 3655 - RNA, 20 nt, Homo Sapiens
cugacuucucacuuccuaag

SEQ ID NO: 3656 - RNA, 19 nt, Homo Sapiens
ccuacuuugcuucucucca

SEQ ID NO: 3657 - RNA, 21 nt, Homo Sapiens
ccuuccuacuuugcuucucuc

SEQ ID NO: 3658 - RNA, 20 nt, Homo Sapiens
gucuauguuuucuacuccaa

SEQ ID NO: 3659 - RNA, 22 nt, Homo Sapiens
guacagguacaggcuggagauu

SEQ ID NO: 3660 - RNA, 21 nt, Homo Sapiens
caguguaacgaugcacuuugg

SEQ ID NO: 3661 - RNA, 21 nt, Homo Sapiens
aauaaaucuagcaccccugau

SEQ ID NO: 3662 - RNA, 25 nt, Homo Sapiens
ucuauucauaagucuuugguacaag

SEQ ID NO: 3663 - RNA, 21 nt, Homo Sapiens
uccugcucuuccauuucuucc

SEQ ID NO: 3664 - RNA, 20 nt, Homo Sapiens
uccuacuuugcuucucucca

SEQ ID NO: 3665 - RNA, 22 nt, Homo Sapiens
uccucaagguagaaaugucuau

SEQ ID NO: 3666 - RNA, 26 nt, Homo Sapiens
uccauccugcucuuccauuucuucca

SEQ ID NO: 3667 - RNA, 19 nt, Homo Sapiens
ugacuucucacuuccuaag

SEQ ID NO: 3668 - RNA, 20 nt, Homo Sapiens
ucuuccacgauggugcagug

SEQ ID NO: 3669 - RNA, 18 nt, Homo Sapiens
uugaagcagaugugguga

SEQ ID NO: 3670 - RNA, 21 nt, Homo Sapiens
uugucccagggcugaugcugu

SEQ ID NO: 3671 - RNA, 22 nt, Homo Sapiens
uuuccagccgaucacuggagcu

SEQ ID NO: 3672 - RNA, 22 nt, Homo Sapiens
uuggcucaccaacccugcaggc

SEQ ID NO: 3673 - RNA, 22 nt, Homo Sapiens
uuccaggguugaaucuuguccc

SEQ ID NO: 3674 - RNA, 20 nt, Homo Sapiens
uuacagccacaggcacugug

SEQ ID NO: 3675 - RNA, 19 nt, Homo Sapiens
uguguuccuggagaaggca

SEQ ID NO: 3676 - RNA, 20 nt, Homo Sapiens
uguguggaaagucagaggaa

SEQ ID NO: 3677 - RNA, 21 nt, Homo Sapiens
ugaaucuucccugucaggcuc

SEQ ID NO: 3678 - RNA, 24 nt, Homo Sapiens
ugucaucugaguugagcacugguc

SEQ ID NO: 3679 - RNA, 21 nt, Homo Sapiens
uguaguuaauuucagugccuu

SEQ ID NO: 3680 - RNA, 26 nt, Homo Sapiens
uggauggaguuaaacuugaugccagu

SEQ ID NO: 3681 - RNA, 22 nt, Homo Sapiens
uggcggcagugacaggaggcgc

SEQ ID NO: 3682 - RNA, 21 nt, Homo Sapiens
ugcuccaguaaaaucuugccu

SEQ ID NO: 3683 - RNA, 22 nt, Homo Sapiens
ugcuuuccuagauccacacuuu

SEQ ID NO: 3684 - RNA, 20 nt, Homo Sapiens
ucauucuucuuggcucacca

SEQ ID NO: 3685 - RNA, 25 nt, Homo Sapiens
ucauuagcugugugacucuggguga

SEQ ID NO: 3686 - RNA, 20 nt, Homo Sapiens
ucauaccuggcuugcaggga

SEQ ID NO: 3687 - RNA, 24 nt, Homo Sapiens
guugcccugccaucgccuccauca

SEQ ID NO: 3688 - RNA, 22 nt, Homo Sapiens
uagaugaaugguuaacacgagc

SEQ ID NO: 3689 - RNA, 27 nt, Homo Sapiens
uauuacugaaagggagggguggagaug

SEQ ID NO: 3690 - RNA, 21 nt, Homo Sapiens
aagggagggguggagaugggu

SEQ ID NO: 3691 - RNA, 20 nt, Homo Sapiens
aaauccagaccuuauccaca

SEQ ID NO: 3692 - RNA, 23 nt, Homo Sapiens
agagaaaccccuccagaacuccc

SEQ ID NO: 3693 - RNA, 29 nt, Homo Sapiens
agagaaaccccuccagaacucccacccug

SEQ ID NO: 3694 - RNA, 21 nt, Homo Sapiens
agaguaagccucuccccucca

SEQ ID NO: 3695 - RNA, 22 nt, Homo Sapiens
agacccaugugcuuccuugcuc

SEQ ID NO: 3696 - RNA, 22 nt, Homo Sapiens
agacauguccccguggcugugg

SEQ ID NO: 3697 - RNA, 20 nt, Homo Sapiens
ccagccaccacugaguccac

SEQ ID NO: 3698 - RNA, 21 nt, Homo Sapiens
cauuguccucugagcugcagu

SEQ ID NO: 3699 - RNA, 27 nt, Homo Sapiens
ccagcuguaguuaauuucagugccuua

SEQ ID NO: 3700 - RNA, 26 nt, Homo Sapiens
cccagccucagccugggacaccuagg

SEQ ID NO: 3701 - RNA, 20 nt, Homo Sapiens
cccacggaaagccucauuug

SEQ ID NO: 3702 - RNA, 30 nt, Homo Sapiens
cccacggaaagccucauuuguguggaaagu

SEQ ID NO: 3703 - RNA, 30 nt, Homo Sapiens
cccuacccauuuggccucuggagggggcag

SEQ ID NO: 3704 - RNA, 27 nt, Homo Sapiens
cccuccagagcccugaguuucuuggcu

SEQ ID NO: 3705 - RNA, 23 nt, Homo Sapiens
cccugacagcccaacaccaccuu

SEQ ID NO: 3706 - RNA, 27 nt, Homo Sapiens
cccugcaggccucaucuuucccaaaac

SEQ ID NO: 3707 - RNA, 24 nt, Homo Sapiens
cccuuccuccuucaugccugggcc

SEQ ID NO: 3708 - RNA, 24 nt, Homo Sapiens
caagaccucccuggaacccuucug

SEQ ID NO: 3709 - RNA, 26 nt, Homo Sapiens
caccccagccaccacugaguccacuc

SEQ ID NO: 3710 - RNA, 19 nt, Homo Sapiens
agggguggagaugggugug

SEQ ID NO: 3711 - RNA, 24 nt, Homo Sapiens
agggguggagauggguguggcagu

SEQ ID NO: 3712 - RNA, 21 nt, Homo Sapiens
aguaagccucuccccuccaga

SEQ ID NO: 3713 - RNA, 21 nt, Homo Sapiens
agugaagccuccaacccuaag

SEQ ID NO: 3714 - RNA, 23 nt, Homo Sapiens
gggguggagauggguguggcagu

SEQ ID NO: 3715 - RNA, 27 nt, Homo Sapiens
ggucaggcaucuucccuucacucaagc

SEQ ID NO: 3716 - RNA, 21 nt, Homo Sapiens
guccugccccuuccuccuuca

SEQ ID NO: 3717 - RNA, 26 nt, Homo Sapiens
gucauuguccucugagcugcaguuuc

SEQ ID NO: 3718 - RNA, 20 nt, Homo Sapiens
gugaagccuccaacccuaag

SEQ ID NO: 3719 - RNA, 23 nt, Homo Sapiens
gugagggcugggggcauccaggc

SEQ ID NO: 3720 - RNA, 21 nt, Homo Sapiens
gugggaaaguggaguccaccc

SEQ ID NO: 3721 - RNA, 17 nt, Homo Sapiens
guggaaagucagaggaa

SEQ ID NO: 3722 - RNA, 32 nt, Homo Sapiens
guggaaagucagaggaaaaaugauccagugga

SEQ ID NO: 3723 - RNA, 20 nt, Homo Sapiens
gcuccaguaaaaucuugccu

SEQ ID NO: 3724 - RNA, 24 nt, Homo Sapiens
ggaagcaucugucuugucauucca

SEQ ID NO: 3725 - RNA, 26 nt, Homo Sapiens
gcagcccaguggaauggaaagaaugu

SEQ ID NO: 3726 - RNA, 23 nt, Homo Sapiens
ccuuccuccuucaugccugggcc

SEQ ID NO: 3727 - RNA, 23 nt, Homo Sapiens
ccguccugccccuuccuccuuca

SEQ ID NO: 3728 - RNA, 21 nt, Homo Sapiens
cucauucuucuuggcucacca

SEQ ID NO: 3729 - RNA, 22 nt, Homo Sapiens
cgguggccagagaugccagcag

SEQ ID NO: 3730 - RNA, 22 nt, Homo Sapiens
cguccugccccuuccuccuuca

SEQ ID NO: 3731 - RNA, 24 nt, Homo Sapiens
cguccugccccuuccuccuucaug

SEQ ID NO: 3732 - RNA, 27 nt, Homo Sapiens
cugugugacucugggugagucccuuaa

SEQ ID NO: 3733 - RNA, 19 nt, Homo Sapiens
cuugucccagccucagccu

SEQ ID NO: 3734 - RNA, 22 nt, Homo Sapiens
cuucccuucacucaagcuuggc

SEQ ID NO: 3735 - RNA, 21 nt, Homo Sapiens
cugccaucgccuccaucagcc

SEQ ID NO: 3736 - RNA, 23 nt, Homo Sapiens
gaagcaucugucuugucauucca

SEQ ID NO: 3737 - RNA, 22 nt, Homo Sapiens
gaauuccuuggagccacuggga

SEQ ID NO: 3738 - RNA, 25 nt, Homo Sapiens
gacuucaagaugccucuucuaccuc

SEQ ID NO: 3739 - RNA, 20 nt, Homo Sapiens
cuggaggacguggacugggg

SEQ ID NO: 3740 - RNA, 20 nt, Homo Sapiens
cuucucccuagugcugguau

SEQ ID NO: 3741 - RNA, 26 nt, Homo Sapiens
cuagcacaucauggcagugggaccaa

SEQ ID NO: 3742 - RNA, 21 nt, Homo Sapiens
cucccucucugcaccugucuc

SEQ ID NO: 3743 - RNA, 20 nt, Homo Sapiens
cucugcaggacacagaucug

SEQ ID NO: 3744 - RNA, 22 nt, Homo Sapiens
cucuguccuggcugugcacauu

SEQ ID NO: 3745 - RNA, 23 nt, Homo Sapiens
ccucacgcucuccaucauaggcu

SEQ ID NO: 3746 - RNA, 19 nt, Homo Sapiens
ccucuucuaccucuuccag

SEQ ID NO: 3747 - RNA, 24 nt, Homo Sapiens
ccuuguucuuagagcagauucuag

SEQ ID NO: 3748 - RNA, 21 nt, Homo Sapiens
gcagccucuguccuggcugug

SEQ ID NO: 3749 - RNA, 22 nt, Homo Sapiens
gccaggcucucccucucugcac

SEQ ID NO: 3750 - RNA, 20 nt, Homo Sapiens
ggaggaugcugugccuccca

SEQ ID NO: 3751 - RNA, 22 nt, Homo Sapiens
gcucauucauauuccugccuuu

SEQ ID NO: 3752 - RNA, 23 nt, Homo Sapiens
gcucauucauauuccugccuuuc

SEQ ID NO: 3753 - RNA, 22 nt, Homo Sapiens
gcuguaagcaccugggcugagg

SEQ ID NO: 3754 - RNA, 21 nt, Homo Sapiens
guccuccuccuggaucuuuag

SEQ ID NO: 3755 - RNA, 22 nt, Homo Sapiens
ggucccggguuagccuggugac

SEQ ID NO: 3756 - RNA, 22 nt, Homo Sapiens
gggcugaggaggcaguuuuugu

SEQ ID NO: 3757 - RNA, 26 nt, Homo Sapiens
gggaagggaggucuccucuagacuga

SEQ ID NO: 3758 - RNA, 23 nt, Homo Sapiens
aggggggaaggggugggagccaa

SEQ ID NO: 3759 - RNA, 23 nt, Homo Sapiens
agugggaggagagggcagagguc

SEQ ID NO: 3760 - RNA, 28 nt, Homo Sapiens
agugggaggagagggcagagguccccug

SEQ ID NO: 3761 - RNA, 20 nt, Homo Sapiens
auauuccugccuuucuucca

SEQ ID NO: 3762 - RNA, 21 nt, Homo Sapiens
cacauugccuugagcuuuuca

SEQ ID NO: 3763 - RNA, 27 nt, Homo Sapiens
cacaggcaaagaggugcugcuuugcuu

SEQ ID NO: 3764 - RNA, 20 nt, Homo Sapiens
augccucuucuaccucuucc

SEQ ID NO: 3765 - RNA, 24 nt, Homo Sapiens
cccucacgcucuccaucauaggcu

SEQ ID NO: 3766 - RNA, 22 nt, Homo Sapiens
ccaggcucucccucucugcacc

SEQ ID NO: 3767 - RNA, 20 nt, Homo Sapiens
cagccucuguccuggcugug

SEQ ID NO: 3768 - RNA, 20 nt, Homo Sapiens
cagcaucuacuacucugucu

SEQ ID NO: 3769 - RNA, 22 nt, Homo Sapiens
agacuucuaggaggaugcugug

SEQ ID NO: 3770 - RNA, 23 nt, Homo Sapiens
acacccuacaaguugaucaugca

SEQ ID NO: 3771 - RNA, 24 nt, Homo Sapiens
acacccuacaaguugaucaugcag

SEQ ID NO: 3772 - RNA, 20 nt, Homo Sapiens
acauugccuugagcuuuuca

SEQ ID NO: 3773 - RNA, 18 nt, Homo Sapiens
aacugauuuuaaaugcaa

SEQ ID NO: 3774 - RNA, 19 nt, Homo Sapiens
uauuccugccuuucuucca

SEQ ID NO: 3775 - RNA, 21 nt, Homo Sapiens
guuagccuggugacaggcaga

SEQ ID NO: 3776 - RNA, 20 nt, Homo Sapiens
ucucccucucugcaccuguc

SEQ ID NO: 3777 - RNA, 24 nt, Homo Sapiens
ucucccucucugcaccugucucau

SEQ ID NO: 3778 - RNA, 23 nt, Homo Sapiens
ugcuucuucaauggcaccuucau

SEQ ID NO: 3779 - RNA, 23 nt, Homo Sapiens
ucuuccaggaagcacaggccagg

SEQ ID NO: 3780 - RNA, 18 nt, Homo Sapiens
ucugucuucacuauucag

SEQ ID NO: 3781 - RNA, 22 nt, Homo Sapiens
uucaguuaaguugcuguaagca

SEQ ID NO: 3782 - RNA, 23 nt, Homo Sapiens
uucauauuccugccuuucuucca

SEQ ID NO: 3783 - RNA, 26 nt, Homo Sapiens
uucauucuccguugucauugacuuca

SEQ ID NO: 3784 - RNA, 19 nt, Homo Sapiens
uuccucugcaggacacaga

SEQ ID NO: 3785 - RNA, 22 nt, Homo Sapiens
uugccuugagcuuuucaguuaa

SEQ ID NO: 3786 - RNA, 22 nt, Homo Sapiens
uugucucuuccucugcaggaca

SEQ ID NO: 3787 - RNA, 17 nt, Homo Sapiens
uguggagguggcugguc

SEQ ID NO: 3788 - RNA, 20 nt, Homo Sapiens
uguuguaggaaaagcuguuc

SEQ ID NO: 3789 - RNA, 22 nt, Homo Sapiens
ugcaugcuuuggaaauuuggaa

SEQ ID NO: 3790 - RNA, 22 nt, Homo Sapiens
ugcggaacucuuccuggaaugc

SEQ ID NO: 3791 - RNA, 20 nt, Homo Sapiens
ugcuuuggaaauuuggaaga

SEQ ID NO: 3792 - RNA, 24 nt, Homo Sapiens
ugcuuuggaaauuuggaagauggu

SEQ ID NO: 3793 - RNA, 25 nt, Homo Sapiens
uguacuuguucuuuucugguagguu

SEQ ID NO: 3794 - RNA, 24 nt, Homo Sapiens
guggugguuucuauacaugaauca

SEQ ID NO: 3795 - RNA, 23 nt, Homo Sapiens
uagguauuauauuuuggccuuac

SEQ ID NO: 3796 - RNA, 21 nt, Homo Sapiens
acaggaagccgccuagugcag

SEQ ID NO: 3797 - RNA, 22 nt, Homo Sapiens
acucuuugcaacagcacuugcu

SEQ ID NO: 3798 - RNA, 22 nt, Homo Sapiens
agcaguuucacugccaacuuuu

SEQ ID NO: 3799 - RNA, 23 nt, Homo Sapiens
aggacgcauuccaaaucauacuc

SEQ ID NO: 3800 - RNA, 25 nt, Homo Sapiens
aggaaagcguuuggaaaacguauca

SEQ ID NO: 3801 - RNA, 27 nt, Homo Sapiens
cccuuguucuaaugcugcacaccaguu

SEQ ID NO: 3802 - RNA, 22 nt, Homo Sapiens
augcagugccuuuccccauuca

SEQ ID NO: 3803 - RNA, 23 nt, Homo Sapiens
aucagugagcucaggagagagcu

SEQ ID NO: 3804 - RNA, 21 nt, Homo Sapiens
aucauacucacgggaggaauc

SEQ ID NO: 3805 - RNA, 23 nt, Homo Sapiens
gggagccgguuugggagagacca

SEQ ID NO: 3806 - RNA, 22 nt, Homo Sapiens
gggcggcggcgacuggagcuuc

SEQ ID NO: 3807 - RNA, 23 nt, Homo Sapiens
gggccaaucacugaguuuguggu

SEQ ID NO: 3808 - RNA, 22 nt, Homo Sapiens
gcuguucccaugucuaacagga

SEQ ID NO: 3809 - RNA, 27 nt, Homo Sapiens
gcuuuuaaacuggagaggcuaaccuca

SEQ ID NO: 3810 - RNA, 21 nt, Homo Sapiens
gcaguuucacugccaacuuuu

SEQ ID NO: 3811 - RNA, 21 nt, Homo Sapiens
gccugcaggggccacucucua

SEQ ID NO: 3812 - RNA, 21 nt, Homo Sapiens
gcggaacucuuccuggaaugc

SEQ ID NO: 3813 - RNA, 23 nt, Homo Sapiens
ccuguuucuaaguggccugcagg

SEQ ID NO: 3814 - RNA, 20 nt, Homo Sapiens
ccugcaggggccacucucua

SEQ ID NO: 3815 - RNA, 27 nt, Homo Sapiens
cuuuucugguagguucugucugugcca

SEQ ID NO: 3816 - RNA, 19 nt, Homo Sapiens
gcgggaaaagcacgugucc

SEQ ID NO: 3817 - RNA, 24 nt, Homo Sapiens
agaaggcaaggccgguguguuuau

SEQ ID NO: 3818 - RNA, 26 nt, Homo Sapiens
ugcagggcgaagagcaggcggcgagc

SEQ ID NO: 3819 - RNA, 21 nt, Homo Sapiens
ucuguaaccucccguugcguc

SEQ ID NO: 3820 - RNA, 22 nt, Homo Sapiens
ugucgcccaggcuggagugcag

SEQ ID NO: 3821 - RNA, 23 nt, Homo Sapiens
ugucgcccaggcuggagugcagu

SEQ ID NO: 3822 - RNA, 21 nt, Homo Sapiens
ucacugcaagcucuaccucuu

SEQ ID NO: 3823 - RNA, 23 nt, Homo Sapiens
uacagguugcugaaaagccagga

SEQ ID NO: 3824 - RNA, 22 nt, Homo Sapiens
ucucacccaggcaaucuugccu

SEQ ID NO: 3825 - RNA, 18 nt, Homo Sapiens
ucgcccaggcuggagugc

SEQ ID NO: 3826 - RNA, 21 nt, Homo Sapiens
ucgcccaggcuggagugcagu

SEQ ID NO: 3827 - RNA, 22 nt, Homo Sapiens
ucgcccaggcuggagugcagug

SEQ ID NO: 3828 - RNA, 23 nt, Homo Sapiens
uucaacacagagaaguugcugcu

SEQ ID NO: 3829 - RNA, 20 nt, Homo Sapiens
uuucucucacugucuauuua

SEQ ID NO: 3830 - RNA, 22 nt, Homo Sapiens
uuugucgcccaggcuggagugc

SEQ ID NO: 3831 - RNA, 26 nt, Homo Sapiens
uuugucgcccaggcuggagugcagug

SEQ ID NO: 3832 - RNA, 22 nt, Homo Sapiens
agccucccaaguagcugggacu

SEQ ID NO: 3833 - RNA, 22 nt, Homo Sapiens
agcucacugcaagcucuaccuc

SEQ ID NO: 3834 - RNA, 27 nt, Homo Sapiens
agcucacugcaagcucuaccucuuggu

SEQ ID NO: 3835 - RNA, 23 nt, Homo Sapiens
acgaucucagcucacugcaagcu

SEQ ID NO: 3836 - RNA, 22 nt, Homo Sapiens
aaccaagauuaugugacuugca

SEQ ID NO: 3837 - RNA, 22 nt, Homo Sapiens
aguggcacgaucucagcucacu

SEQ ID NO: 3838 - RNA, 23 nt, Homo Sapiens
aggcuggagugcaguggcacgau

SEQ ID NO: 3839 - RNA, 26 nt, Homo Sapiens
cccuccagccccguccgggagucccc

SEQ ID NO: 3840 - RNA, 19 nt, Homo Sapiens
cccaggcuggagugcagug

SEQ ID NO: 3841 - RNA, 20 nt, Homo Sapiens
cccaggcuggagugcagugg

SEQ ID NO: 3842 - RNA, 19 nt, Homo Sapiens
ccaggcuggagugcagugg

SEQ ID NO: 3843 - RNA, 26 nt, Homo Sapiens
ccagccgcccgcgcccuccagccccg

SEQ ID NO: 3844 - RNA, 24 nt, Homo Sapiens
ccagggaaagagaaaacucgcccu

SEQ ID NO: 3845 - RNA, 23 nt, Homo Sapiens
ccauucuccugccccagccuccc

SEQ ID NO: 3846 - RNA, 22 nt, Homo Sapiens
cccagccucccaaguagcuggg

SEQ ID NO: 3847 - RNA, 22 nt, Homo Sapiens
cccaaguagcugggacuacagg

SEQ ID NO: 3848 - RNA, 22 nt, Homo Sapiens
caggcuggagugcaguggcacg

SEQ ID NO: 3849 - RNA, 27 nt, Homo Sapiens
caggcuggagugcaguggcacgaucuc

SEQ ID NO: 3850 - RNA, 22 nt, Homo Sapiens
ccaaguagcugggacuacaggu

SEQ ID NO: 3851 - RNA, 22 nt, Homo Sapiens
gcccaggcuggagugcaguggc

SEQ ID NO: 3852 - RNA, 25 nt, Homo Sapiens
gcccaggcuggagugcaguggcacg

SEQ ID NO: 3853 - RNA, 20 nt, Homo Sapiens
gcacggcaaccgcgaggccu

SEQ ID NO: 3854 - RNA, 19 nt, Homo Sapiens
gcccaggcuggagugcagu

SEQ ID NO: 3855 - RNA, 21 nt, Homo Sapiens
ggagaggggagcagagccgga

SEQ ID NO: 3856 - RNA, 27 nt, Homo Sapiens
ggagaggggagcagagccggaguuggg

SEQ ID NO: 3857 - RNA, 16 nt, Homo Sapiens
gcugcuugugaucuca

SEQ ID NO: 3858 - RNA, 21 nt, Homo Sapiens
gcucacugcaagcucuaccuc

SEQ ID NO: 3859 - RNA, 22 nt, Homo Sapiens
gcucacugcaagcucuaccucu

SEQ ID NO: 3860 - RNA, 27 nt, Homo Sapiens
gcucacugcaagcucuaccucuugguu

SEQ ID NO: 3861 - RNA, 32 nt, Homo Sapiens
gcucacugcaagcucuaccucuugguucacgc

SEQ ID NO: 3862 - RNA, 22 nt, Homo Sapiens
gucgcccaggcuggagugcagu

SEQ ID NO: 3863 - RNA, 23 nt, Homo Sapiens
gucgcccaggcuggagugcagug

SEQ ID NO: 3864 - RNA, 21 nt, Homo Sapiens
cuuucucucacugucuauuua

SEQ ID NO: 3865 - RNA, 20 nt, Homo Sapiens
ccuucugguuucuuccagcc

SEQ ID NO: 3866 - RNA, 26 nt, Homo Sapiens
cugaaaacugugucuuccuggagacu

SEQ ID NO: 3867 - RNA, 26 nt, Homo Sapiens
cucacacacagauuuuuauguuuucu

SEQ ID NO: 3868 - RNA, 20 nt, Homo Sapiens
cgcccaggcuggagugcagu

SEQ ID NO: 3869 - RNA, 21 nt, Homo Sapiens
cgcccaggcuggagugcagug

SEQ ID NO: 3870 - RNA, 22 nt, Homo Sapiens
cgcccaggcuggagugcagugg

SEQ ID NO: 3871 - RNA, 22 nt, Homo Sapiens
cgccccggagggaggccgaggg

SEQ ID NO: 3872 - RNA, 19 nt, Homo Sapiens
cuugcagaaucaccacacg

SEQ ID NO: 3873 - RNA, 20 nt, Homo Sapiens
cugagcugcugguucacucu

SEQ ID NO: 3874 - RNA, 26 nt, Homo Sapiens
cugagcugcugguucacucuucagca

SEQ ID NO: 3875 - RNA, 25 nt, Homo Sapiens
gucauuuggcaaaggagaugacuua

SEQ ID NO: 3876 - RNA, 24 nt, Homo Sapiens
ggguaaaagcccacccuacagaaa

SEQ ID NO: 3877 - RNA, 22 nt, Homo Sapiens
gggcugagaagauccugaguac

SEQ ID NO: 3878 - RNA, 22 nt, Homo Sapiens
gggagagaagggcagcagcuua

SEQ ID NO: 3879 - RNA, 20 nt, Homo Sapiens
gcuggcuuuggaaugagguu

SEQ ID NO: 3880 - RNA, 19 nt, Homo Sapiens
gcuguuguaaaaugccuuc

SEQ ID NO: 3881 - RNA, 19 nt, Homo Sapiens
gcagacagaccaggaacac

SEQ ID NO: 3882 - RNA, 20 nt, Homo Sapiens
gcaguuucccacuugccaaa

SEQ ID NO: 3883 - RNA, 26 nt, Homo Sapiens
gcaguuucccacuugccaaagauccc

SEQ ID NO: 3884 - RNA, 28 nt, Homo Sapiens
gcccggaccugaugugaaaggaccacgg

SEQ ID NO: 3885 - RNA, 18 nt, Homo Sapiens
gcccuucaucagccuggg

SEQ ID NO: 3886 - RNA, 27 nt, Homo Sapiens
caugcucuguggccuucuuacacuucu

SEQ ID NO: 3887 - RNA, 26 nt, Homo Sapiens
caguguccguguuaauguauuuggcu

SEQ ID NO: 3888 - RNA, 24 nt, Homo Sapiens
ccagcccuucaucagccugggcag

SEQ ID NO: 3889 - RNA, 27 nt, Homo Sapiens
ccccagccaacuucaugggucacuuuu

SEQ ID NO: 3890 - RNA, 21 nt, Homo Sapiens
agggcagcagcuuauuggugg

SEQ ID NO: 3891 - RNA, 23 nt, Homo Sapiens
caaagcccuccagccuguuugug

SEQ ID NO: 3892 - RNA, 24 nt, Homo Sapiens
caaagcccuccagccuguuugugg

SEQ ID NO: 3893 - RNA, 17 nt, Homo Sapiens
auuggcagaaacaguga

SEQ ID NO: 3894 - RNA, 24 nt, Homo Sapiens
aagugaucucagaggggcccaugg

SEQ ID NO: 3895 - RNA, 24 nt, Homo Sapiens
aaugguugggggagagaagggcag

SEQ ID NO: 3896 - RNA, 17 nt, Homo Sapiens
agaaauucugcaguggc

SEQ ID NO: 3897 - RNA, 21 nt, Homo Sapiens
agcaguuucccacuugccaaa

SEQ ID NO: 3898 - RNA, 22 nt, Homo Sapiens
agcaguuucccacuugccaaag

SEQ ID NO: 3899 - RNA, 27 nt, Homo Sapiens
agcaguuucccacuugccaaagauccc

SEQ ID NO: 3900 - RNA, 22 nt, Homo Sapiens
uuuucucaaauccuggagagag

SEQ ID NO: 3901 - RNA, 23 nt, Homo Sapiens
uguguaguguggucugggcaggc

SEQ ID NO: 3902 - RNA, 25 nt, Homo Sapiens
uucacucuucagcauuuaugaaaca

SEQ ID NO: 3903 - RNA, 23 nt, Homo Sapiens
uccuagacuggacucuugaggga

SEQ ID NO: 3904 - RNA, 22 nt, Homo Sapiens
ucaucccaagguccgucccaug

SEQ ID NO: 3905 - RNA, 21 nt, Homo Sapiens
guugggggagagaagggcagc

SEQ ID NO: 3906 - RNA, 28 nt, Homo Sapiens
uguaguguggucugggcaggcagaccuu

SEQ ID NO: 3907 - RNA, 21 nt, Homo Sapiens
ugggggagagaagggcagcag

SEQ ID NO: 3908 - RNA, 24 nt, Homo Sapiens
ugguugucauuuggcaaaggagau

SEQ ID NO: 3909 - RNA, 23 nt, Homo Sapiens
ugccuucagaaauaaguccuaga

SEQ ID NO: 3910 - RNA, 21 nt, Homo Sapiens
ugagccaggccugggucugug

SEQ ID NO: 3911 - RNA, 22 nt, Homo Sapiens
ucugacauuaacaguuuuccau

SEQ ID NO: 3912 - RNA, 23 nt, Homo Sapiens
ugcuucacagcgcccaccugucu

SEQ ID NO: 3913 - RNA, 24 nt, Homo Sapiens
gugucucuuuucucuuucuccuua

SEQ ID NO: 3914 - RNA, 20 nt, Homo Sapiens
uaucugugcgugaaacacac

SEQ ID NO: 3915 - RNA, 23 nt, Homo Sapiens
uuccuggcaauaguguguucuga

SEQ ID NO: 3916 - RNA, 27 nt, Homo Sapiens
uguucugacauuaacaguuuuccauga

SEQ ID NO: 3917 - RNA, 24 nt, Homo Sapiens
agcagugaccgugcuccuacccag

SEQ ID NO: 3918 - RNA, 27 nt, Homo Sapiens
aggcagccggcacccacaagugccacu

SEQ ID NO: 3919 - RNA, 27 nt, Homo Sapiens
acacuucagagagcugguaguuaguag

SEQ ID NO: 3920 - RNA, 22 nt, Homo Sapiens
auuuaagcauuguuugcuuauu

SEQ ID NO: 3921 - RNA, 23 nt, Homo Sapiens
cacaccaggcugugggccucaag

SEQ ID NO: 3922 - RNA, 23 nt, Homo Sapiens
caauguucauuguaauguuacug

SEQ ID NO: 3923 - RNA, 23 nt, Homo Sapiens
aggguuccuguagaccuagggag

SEQ ID NO: 3924 - RNA, 21 nt, Homo Sapiens
caggccugggucugugucucu

SEQ ID NO: 3925 - RNA, 22 nt, Homo Sapiens
gcccgagcuggugcauuacaga

SEQ ID NO: 3926 - RNA, 24 nt, Homo Sapiens
ggucugugucucuuuucucuuucu

SEQ ID NO: 3927 - RNA, 21 nt, Homo Sapiens
cuuuucucuuucuccuuaguc

SEQ ID NO: 3928 - RNA, 26 nt, Homo Sapiens
gagaaacacaucuucccuagaggguu

SEQ ID NO: 3929 - RNA, 22 nt, Homo Sapiens
gaauguucugacauuaacaguu

SEQ ID NO: 3930 - RNA, 23 nt, Homo Sapiens
gaguguguauuguucccagugac

SEQ ID NO: 3931 - RNA, 22 nt, Homo Sapiens
ccggcacccacaagugccacug

SEQ ID NO: 3932 - RNA, 23 nt, Homo Sapiens
ccuacccuaaugccaguuccagc

SEQ ID NO: 3933 - RNA, 21 nt, Homo Sapiens
ccucuaucacgaagauauuga

SEQ ID NO: 3934 - RNA, 25 nt, Homo Sapiens
gacacaaaauauuggaagaguggca

SEQ ID NO: 3935 - RNA, 23 nt, Homo Sapiens
ggcucuggcugugcauucagcag

SEQ ID NO: 3936 - RNA, 22 nt, Homo Sapiens
gcacccacugcauuugcagccu

SEQ ID NO: 3937 - RNA, 19 nt, Homo Sapiens
gcauuuucuacauguauua

SEQ ID NO: 3938 - RNA, 21 nt, Homo Sapiens
cauuccugccugacaggacca

SEQ ID NO: 3939 - RNA, 22 nt, Homo Sapiens
ccagagagaggccaaggcugau

SEQ ID NO: 3940 - RNA, 22 nt, Homo Sapiens
ccacugcauuugcagccuugag

SEQ ID NO: 3941 - RNA, 27 nt, Homo Sapiens
ccacugcauuugcagccuugaggucau

SEQ ID NO: 3942 - RNA, 24 nt, Homo Sapiens
cccacugcauuugcagccuugagg

SEQ ID NO: 3943 - RNA, 24 nt, Homo Sapiens
cacagguuguagagauagagaugg

SEQ ID NO: 3944 - RNA, 25 nt, Homo Sapiens
auggauuugcacccacugcauuugc

SEQ ID NO: 3945 - RNA, 22 nt, Homo Sapiens
acacuccuaaauuuagagucaa

SEQ ID NO: 3946 - RNA, 23 nt, Homo Sapiens
aauaaaccacacuuaguccugau

SEQ ID NO: 3947 - RNA, 24 nt, Homo Sapiens
agagguggggaacaaguaaaagcu

SEQ ID NO: 3948 - RNA, 20 nt, Homo Sapiens
uugcauuuuaucaaaugcau

SEQ ID NO: 3949 - RNA, 25 nt, Homo Sapiens
uuugcacccacugcauuugcagccu

SEQ ID NO: 3950 - RNA, 24 nt, Homo Sapiens
uagguuuuuuauagcuauuaaaaa

SEQ ID NO: 3951 - RNA, 21 nt, Homo Sapiens
uaaugccaguuccagcuucau

SEQ ID NO: 3952 - RNA, 28 nt, Homo Sapiens
guuauaucagacuggagcaccagagaga

SEQ ID NO: 3953 - RNA, 23 nt, Homo Sapiens
uggugagagaaagugaaaugaaa

SEQ ID NO: 3954 - RNA, 18 nt, Homo Sapiens
ucucugaaaaggaauuga

SEQ ID NO: 3955 - RNA, 23 nt, Homo Sapiens
ugcacccacugcauuugcagccu

SEQ ID NO: 3956 - RNA, 21 nt, Homo Sapiens
uguuugucugugugcuguaac

SEQ ID NO: 3957 - RNA, 22 nt, Homo Sapiens
agccuccugggcauguuugucu

SEQ ID NO: 3958 - RNA, 18 nt, Homo Sapiens
ccuguucucuuugccuug

SEQ ID NO: 3959 - RNA, 26 nt, Homo Sapiens
cuccugggcauguuugucugugugcu

SEQ ID NO: 3960 - RNA, 19 nt, Homo Sapiens
cuccgccucugcuggcaca

SEQ ID NO: 3961 - RNA, 24 nt, Homo Sapiens
cuccgccucugcuggcacauuucc

SEQ ID NO: 3962 - RNA, 23 nt, Homo Sapiens
cucuuccuugcugugucauacca

SEQ ID NO: 3963 - RNA, 19 nt, Homo Sapiens
cguccugccaccuggggca

SEQ ID NO: 3964 - RNA, 23 nt, Homo Sapiens
ccuguguagcugggauuauagau

SEQ ID NO: 3965 - RNA, 27 nt, Homo Sapiens
ccuguguagcugggauuauagauugga

SEQ ID NO: 3966 - RNA, 28 nt, Homo Sapiens
ccugcugcugcugcugcugcuaaucuuc

SEQ ID NO: 3967 - RNA, 26 nt, Homo Sapiens
ccuugaacuccugggcucaagcaguc

SEQ ID NO: 3968 - RNA, 22 nt, Homo Sapiens
ccuuugaguuuccucaggcugc

SEQ ID NO: 3969 - RNA, 27 nt, Homo Sapiens
ccuuugaguuuccucaggcugcuggag

SEQ ID NO: 3970 - RNA, 25 nt, Homo Sapiens
ccuccugccaccugcugcugcugcu

SEQ ID NO: 3971 - RNA, 18 nt, Homo Sapiens
ccugccaccugcugcugc

SEQ ID NO: 3972 - RNA, 27 nt, Homo Sapiens
ccuaggcugaccuugaacuccugggcu

SEQ ID NO: 3973 - RNA, 22 nt, Homo Sapiens
gaacuccugggcucaagcaguc

SEQ ID NO: 3974 - RNA, 23 nt, Homo Sapiens
cugugggcaggugggagcuugau

SEQ ID NO: 3975 - RNA, 21 nt, Homo Sapiens
cugccaccugcugcugcugcu

SEQ ID NO: 3976 - RNA, 22 nt, Homo Sapiens
cugccaccugcugcugcugcug

SEQ ID NO: 3977 - RNA, 22 nt, Homo Sapiens
cugcuccccucccuccucuguc

SEQ ID NO: 3978 - RNA, 21 nt, Homo Sapiens
cugcugcugcugcuaaucuuc

SEQ ID NO: 3979 - RNA, 24 nt, Homo Sapiens
cugcugcugcugcugcuaaucuuc

SEQ ID NO: 3980 - RNA, 26 nt, Homo Sapiens
gccacugccacacgucugacccucuc

SEQ ID NO: 3981 - RNA, 25 nt, Homo Sapiens
gcugggagggauagaggggggcugc

SEQ ID NO: 3982 - RNA, 25 nt, Homo Sapiens
gcugcugcugcugcugcuaaucuuc

SEQ ID NO: 3983 - RNA, 20 nt, Homo Sapiens
gcugccuggcccccagcugu

SEQ ID NO: 3984 - RNA, 21 nt, Homo Sapiens
gcugaccuugaacuccugggc

SEQ ID NO: 3985 - RNA, 23 nt, Homo Sapiens
gcugaccuugaacuccugggcuc

SEQ ID NO: 3986 - RNA, 27 nt, Homo Sapiens
ggagagggaugaggugcugggagggau

SEQ ID NO: 3987 - RNA, 24 nt, Homo Sapiens
gcuuugacugagcagacuggugag

SEQ ID NO: 3988 - RNA, 21 nt, Homo Sapiens
gcuugauucucagcacuuggg

SEQ ID NO: 3989 - RNA, 25 nt, Homo Sapiens
gcuugauucucagcacuugggggau

SEQ ID NO: 3990 - RNA, 22 nt, Homo Sapiens
gcuugcguuagaaugaggagga

SEQ ID NO: 3991 - RNA, 26 nt, Homo Sapiens
ggagagaaaggggauguauccauggg

SEQ ID NO: 3992 - RNA, 24 nt, Homo Sapiens
ggcugaccuugaacuccugggcuc

SEQ ID NO: 3993 - RNA, 26 nt, Homo Sapiens
ggcugcuggaggaaaacugagacuca

SEQ ID NO: 3994 - RNA, 22 nt, Homo Sapiens
gggagcuugauucucagcacuu

SEQ ID NO: 3995 - RNA, 21 nt, Homo Sapiens
ggggcagucaccugcccagau

SEQ ID NO: 3996 - RNA, 23 nt, Homo Sapiens
ggggcagucuggaggggcauggc

SEQ ID NO: 3997 - RNA, 27 nt, Homo Sapiens
gggggaucuguuguguacguggagagg

SEQ ID NO: 3998 - RNA, 27 nt, Homo Sapiens
guaaaacugaggcacgagcaaagugaa

SEQ ID NO: 3999 - RNA, 22 nt, Homo Sapiens
agccuccuguguagcugggauu

SEQ ID NO: 4000 - RNA, 21 nt, Homo Sapiens
aggaaaacugagacucagaca

SEQ ID NO: 4001 - RNA, 18 nt, Homo Sapiens
agaccugagcuccccacc

SEQ ID NO: 4002 - RNA, 20 nt, Homo Sapiens
acgcugguagagauggagga

SEQ ID NO: 4003 - RNA, 22 nt, Homo Sapiens
acccaccucagccuccugugua

SEQ ID NO: 4004 - RNA, 22 nt, Homo Sapiens
acccugaucagucuaagauggg

SEQ ID NO: 4005 - RNA, 21 nt, Homo Sapiens
acugggagggcccacuucagg

SEQ ID NO: 4006 - RNA, 20 nt, Homo Sapiens
agggcacugcugcugccuuu

SEQ ID NO: 4007 - RNA, 27 nt, Homo Sapiens
augacuuugucccauuucuaaaggccu

SEQ ID NO: 4008 - RNA, 20 nt, Homo Sapiens
ccagggaugccaucuguggg

SEQ ID NO: 4009 - RNA, 19 nt, Homo Sapiens
cccucccuccucugucccu

SEQ ID NO: 4010 - RNA, 24 nt, Homo Sapiens
cccucccuccucugucccuagguc

SEQ ID NO: 4011 - RNA, 24 nt, Homo Sapiens
caggcugcuggaggaaaacugaga

SEQ ID NO: 4012 - RNA, 21 nt, Homo Sapiens
caguccaccugagcugccauc

SEQ ID NO: 4013 - RNA, 22 nt, Homo Sapiens
uucuccucuccccucuaaggcc

SEQ ID NO: 4014 - RNA, 21 nt, Homo Sapiens
ugccaccugcugcugcugcug

SEQ ID NO: 4015 - RNA, 22 nt, Homo Sapiens
ugaacuccugggcucaagcagu

SEQ ID NO: 4016 - RNA, 20 nt, Homo Sapiens
uggagccaccaugcccagcu

SEQ ID NO: 4017 - RNA, 19 nt, Homo Sapiens
uagagauggaggaggaggc

SEQ ID NO: 4018 - RNA, 23 nt, Homo Sapiens
ucagcacuugggggaucuguugu

SEQ ID NO: 4019 - RNA, 19 nt, Homo Sapiens
uccucuugaagaugcugaa

SEQ ID NO: 4020 - RNA, 21 nt, Homo Sapiens
ucuccucuccccucuaaggcc

SEQ ID NO: 4021 - RNA, 25 nt, Homo Sapiens
uccacgaagaaagcaacgaaugaaa

SEQ ID NO: 4022 - RNA, 20 nt, Homo Sapiens
uaacccaccaaccugccugu

SEQ ID NO: 4023 - RNA, 21 nt, Homo Sapiens
uggagaaggugggcacuggau

SEQ ID NO: 4024 - RNA, 21 nt, Homo Sapiens
ugcuuguuugcuucaacuguc

SEQ ID NO: 4025 - RNA, 19 nt, Homo Sapiens
uguccccuucuccaucgcc

SEQ ID NO: 4026 - RNA, 20 nt, Homo Sapiens
ucuggagaaggugggcacug

SEQ ID NO: 4027 - RNA, 22 nt, Homo Sapiens
uucauuucaucuaccauuuucu

SEQ ID NO: 4028 - RNA, 23 nt, Homo Sapiens
uuccauuuaauggggugcaccug

SEQ ID NO: 4029 - RNA, 20 nt, Homo Sapiens
uucccccucucccaguuguc

SEQ ID NO: 4030 - RNA, 20 nt, Homo Sapiens
uguguaacugcccaaagcag

SEQ ID NO: 4031 - RNA, 24 nt, Homo Sapiens
uuaauuucuucacaccuacccucc

SEQ ID NO: 4032 - RNA, 22 nt, Homo Sapiens
caguuaaucuugcuuucuuugu

SEQ ID NO: 4033 - RNA, 27 nt, Homo Sapiens
caguuaaucuugcuuucuuuguuuggc

SEQ ID NO: 4034 - RNA, 23 nt, Homo Sapiens
auaauaaggaauaaaccccaccu

SEQ ID NO: 4035 - RNA, 22 nt, Homo Sapiens
auccaggucacggggcaccaaa

SEQ ID NO: 4036 - RNA, 20 nt, Homo Sapiens
auaguauuuuuauauuuaaa

SEQ ID NO: 4037 - RNA, 22 nt, Homo Sapiens
aauuuuguaucuugaugucuuu

SEQ ID NO: 4038 - RNA, 20 nt, Homo Sapiens
agaccugacguacucugguu

SEQ ID NO: 4039 - RNA, 24 nt, Homo Sapiens
agaccuuaacccaccaaccugccu

SEQ ID NO: 4040 - RNA, 28 nt, Homo Sapiens
agcaguacugcggccuccucuccucucc

SEQ ID NO: 4041 - RNA, 20 nt, Homo Sapiens
aggccagcugugguuuucuu

SEQ ID NO: 4042 - RNA, 22 nt, Homo Sapiens
aacacuuguaauuuuguaucuu

SEQ ID NO: 4043 - RNA, 24 nt, Homo Sapiens
aaagaagaaaagguucuuacugcu

SEQ ID NO: 4044 - RNA, 26 nt, Homo Sapiens
aaagaagaaaagguucuuacugcuug

SEQ ID NO: 4045 - RNA, 21 nt, Homo Sapiens
ggggugcaccuguccaauagg

SEQ ID NO: 4046 - RNA, 18 nt, Homo Sapiens
guccccuucuccaucgcc

SEQ ID NO: 4047 - RNA, 20 nt, Homo Sapiens
gggaacaccuuccaccauga

SEQ ID NO: 4048 - RNA, 23 nt, Homo Sapiens
ggccuccucuccucuccuaaccu

SEQ ID NO: 4049 - RNA, 20 nt, Homo Sapiens
ggagagaagguagggguugg

SEQ ID NO: 4050 - RNA, 21 nt, Homo Sapiens
gccuacucugugaacuccggg

SEQ ID NO: 4051 - RNA, 21 nt, Homo Sapiens
gcgaccagcggggauccuccc

SEQ ID NO: 4052 - RNA, 27 nt, Homo Sapiens
cuguggcaggccagcugugguuuucuu

SEQ ID NO: 4053 - RNA, 21 nt, Homo Sapiens
cuucccccucucccaguuguc

SEQ ID NO: 4054 - RNA, 21 nt, Homo Sapiens
gaaagcuccggugcuuggacc

SEQ ID NO: 4055 - RNA, 25 nt, Homo Sapiens
gaggagauggggacagggcuggagu

SEQ ID NO: 4056 - RNA, 21 nt, Homo Sapiens
ccuaccucugcucuuggagga

SEQ ID NO: 4057 - RNA, 23 nt, Homo Sapiens
cucugcucuuggaggagaugggg

SEQ ID NO: 4058 - RNA, 21 nt, Homo Sapiens
cuccuaguucuucaucccacu

SEQ ID NO: 4059 - RNA, 16 nt, Homo Sapiens
aagagagugaucaugu

SEQ ID NO: 4060 - RNA, 23 nt, Homo Sapiens
uucuucugugggagaacuuaaug

SEQ ID NO: 4061 - RNA, 20 nt, Homo Sapiens
ugucaguguuugggaaauua

SEQ ID NO: 4062 - RNA, 21 nt, Homo Sapiens
gaguccuugcaaaauugucua

SEQ ID NO: 4063 - RNA, 17 nt, Homo Sapiens
gacuauacagugucacu

SEQ ID NO: 4064 - RNA, 28 nt, Homo Sapiens
ccggacaugcaggugaauauuuuaauag

SEQ ID NO: 4065 - RNA, 24 nt, Homo Sapiens
gcauggcacugacaucugccuugu

SEQ ID NO: 4066 - RNA, 24 nt, Homo Sapiens
ggaggcugggaaggcgaagggcau

SEQ ID NO: 4067 - RNA, 22 nt, Homo Sapiens
ggagaaggaaaaagaacuuacg

SEQ ID NO: 4068 - RNA, 20 nt, Homo Sapiens
gugaaaaauuaacaugugga

SEQ ID NO: 4069 - RNA, 32 nt, Homo Sapiens
aagucaaagacaggaagagaucagagugaaug

SEQ ID NO: 4070 - RNA, 22 nt, Homo Sapiens
aaagaaauuuauuuucuuccua

SEQ ID NO: 4071 - RNA, 21 nt, Homo Sapiens
agaauggaguccucaugaccu

SEQ ID NO: 4072 - RNA, 21 nt, Homo Sapiens
acuucuauauaugaaugucuu

SEQ ID NO: 4073 - RNA, 20 nt, Homo Sapiens
acacacacauuuaucauuua

SEQ ID NO: 4074 - RNA, 22 nt, Homo Sapiens
acacauuuaucauuuaaugcau

SEQ ID NO: 4075 - RNA, 20 nt, Homo Sapiens
aauucuuuaaucuguccagu

SEQ ID NO: 4076 - RNA, 21 nt, Homo Sapiens
acucacugaagcuucgauuuc

SEQ ID NO: 4077 - RNA, 25 nt, Homo Sapiens
agugucacucauuuguaguaaaacu

SEQ ID NO: 4078 - RNA, 21 nt, Homo Sapiens
aucccggagaaggaaaaagaa

SEQ ID NO: 4079 - RNA, 23 nt, Homo Sapiens
agggcauggcacugacaucugcc

SEQ ID NO: 4080 - RNA, 31 nt, Homo Sapiens
agggcauggcacugacaucugccuuguaacu

SEQ ID NO: 4081 - RNA, 22 nt, Homo Sapiens
cacucacugaagcuucgauuuc

SEQ ID NO: 4082 - RNA, 21 nt, Homo Sapiens
cagucccaguuucucuuauua

SEQ ID NO: 4083 - RNA, 27 nt, Homo Sapiens
caguagaacuaugucggagcacucacu

SEQ ID NO: 4084 - RNA, 18 nt, Homo Sapiens
ugcuaaaguaauuuacaa

SEQ ID NO: 4085 - RNA, 21 nt, Homo Sapiens
ugaagcuucgauuucccacug

SEQ ID NO: 4086 - RNA, 22 nt, Homo Sapiens
ucuuugguaguuuuuugcacua

SEQ ID NO: 4087 - RNA, 26 nt, Homo Sapiens
ugauuacuauauuuuguucacacuaa

SEQ ID NO: 4088 - RNA, 25 nt, Homo Sapiens
uauuaauaaaacuuuggaaauugcu

SEQ ID NO: 4089 - RNA, 20 nt, Homo Sapiens
ucccggagaaggaaaaagaa

SEQ ID NO: 4090 - RNA, 22 nt, Homo Sapiens
ucaugaucucaggauguaugga

SEQ ID NO: 4091 - RNA, 26 nt, Homo Sapiens
uccaauaaauuauauaccugccuaag

SEQ ID NO: 4092 - RNA, 32 nt, Homo Sapiens
uccuaucauucauuccuucauucugaacaggc

SEQ ID NO: 4093 - RNA, 22 nt, Homo Sapiens
uucaccaaaccaaauguggaaa

SEQ ID NO: 4094 - RNA, 22 nt, Homo Sapiens
uguuuuuuaaaaguaauuuuua

SEQ ID NO: 4095 - RNA, 22 nt, Homo Sapiens
ucugcccuuccuuucccugggg

SEQ ID NO: 4096 - RNA, 22 nt, Homo Sapiens
agcuugggaggaagcccaguag

SEQ ID NO: 4097 - RNA, 21 nt, Homo Sapiens
ggggccauucguaugcagccu

SEQ ID NO: 4098 - RNA, 22 nt, Homo Sapiens
gggggagcugaaagggagcccc

SEQ ID NO: 4099 - RNA, 27 nt, Homo Sapiens
gggggagcugaaagggagccccugcuc

SEQ ID NO: 4100 - RNA, 20 nt, Homo Sapiens
ggggcagcaggagcgguaga

SEQ ID NO: 4101 - RNA, 19 nt, Homo Sapiens
gggcagcaggagcgguaga

SEQ ID NO: 4102 - RNA, 27 nt, Homo Sapiens
ggcuggcuguuggccccucugcugucc

SEQ ID NO: 4103 - RNA, 26 nt, Homo Sapiens
gggagagacugugaggcggcagcugg

SEQ ID NO: 4104 - RNA, 22 nt, Homo Sapiens
ggcucugcuuccucagcccuag

SEQ ID NO: 4105 - RNA, 23 nt, Homo Sapiens
ggcgacugucauguggcuugguu

SEQ ID NO: 4106 - RNA, 25 nt, Homo Sapiens
ggcuccuguuucucauccuagcuuu

SEQ ID NO: 4107 - RNA, 25 nt, Homo Sapiens
ggccucccacuccuguuccuugcua

SEQ ID NO: 4108 - RNA, 25 nt, Homo Sapiens
ggccaggguagacuuggagcugucc

SEQ ID NO: 4109 - RNA, 19 nt, Homo Sapiens
ggagugagaagaaggaaga

SEQ ID NO: 4110 - RNA, 21 nt, Homo Sapiens
ggcagggagugucugcagucc

SEQ ID NO: 4111 - RNA, 27 nt, Homo Sapiens
gugagcaggcuuugggaacacuggccu

SEQ ID NO: 4112 - RNA, 22 nt, Homo Sapiens
guggcggggcagcaggagcggu

SEQ ID NO: 4113 - RNA, 19 nt, Homo Sapiens
guccacccucauuucugcc

SEQ ID NO: 4114 - RNA, 27 nt, Homo Sapiens
gucagagggacugucagcugagcuuga

SEQ ID NO: 4115 - RNA, 20 nt, Homo Sapiens
gucuuccucuuguuuacgac

SEQ ID NO: 4116 - RNA, 28 nt, Homo Sapiens
ggguagaauuguuuggcaaugcacugaa

SEQ ID NO: 4117 - RNA, 30 nt, Homo Sapiens
ggguagaauuguuuggcaaugcacugaagc

SEQ ID NO: 4118 - RNA, 29 nt, Homo Sapiens
gguuguugccagguugcagcugcucuugc

SEQ ID NO: 4119 - RNA, 26 nt, Homo Sapiens
gguggguggagucaggcuucucuugc

SEQ ID NO: 4120 - RNA, 23 nt, Homo Sapiens
ggagcucgggacggauaguagac

SEQ ID NO: 4121 - RNA, 24 nt, Homo Sapiens
gcugacaucuugcacggugacccc

SEQ ID NO: 4122 - RNA, 26 nt, Homo Sapiens
gcucuuuguggcaguggccaggcagg

SEQ ID NO: 4123 - RNA, 21 nt, Homo Sapiens
gcuggauuugggagcucugcu

SEQ ID NO: 4124 - RNA, 25 nt, Homo Sapiens
gccagcccucccuggcugugagcag

SEQ ID NO: 4125 - RNA, 18 nt, Homo Sapiens
gcagguggccacagcagg

SEQ ID NO: 4126 - RNA, 24 nt, Homo Sapiens
gcgcucaacugcagccccuccucc

SEQ ID NO: 4127 - RNA, 22 nt, Homo Sapiens
ccuaugggcuuccgcacaugcc

SEQ ID NO: 4128 - RNA, 22 nt, Homo Sapiens
ccguugcgggguggagugaggu

SEQ ID NO: 4129 - RNA, 23 nt, Homo Sapiens
ccuccugggaaggagggagcugc

SEQ ID NO: 4130 - RNA, 26 nt, Homo Sapiens
ccuucccagcagacauccucaucggg

SEQ ID NO: 4131 - RNA, 21 nt, Homo Sapiens
ccugggaaggagggagcugcu

SEQ ID NO: 4132 - RNA, 23 nt, Homo Sapiens
cuccuguuucucauccuagcuuu

SEQ ID NO: 4133 - RNA, 20 nt, Homo Sapiens
cucccuucucucuuuucuuc

SEQ ID NO: 4134 - RNA, 24 nt, Homo Sapiens
cgccuuccccucaguuguuucuaa

SEQ ID NO: 4135 - RNA, 22 nt, Homo Sapiens
cgguucuuccuggaaguugacu

SEQ ID NO: 4136 - RNA, 20 nt, Homo Sapiens
gaacccccuccagacaccca

SEQ ID NO: 4137 - RNA, 28 nt, Homo Sapiens
gacagcagccucccugucacucagcuga

SEQ ID NO: 4138 - RNA, 21 nt, Homo Sapiens
gcaccauucucccuucucucu

SEQ ID NO: 4139 - RNA, 24 nt, Homo Sapiens
gagcagccuccacuguguccagag

SEQ ID NO: 4140 - RNA, 24 nt, Homo Sapiens
gaucguggccaacguggaccugcc

SEQ ID NO: 4141 - RNA, 21 nt, Homo Sapiens
gagugucacugagcuguguuu

SEQ ID NO: 4142 - RNA, 21 nt, Homo Sapiens
cuuggagcuguccuccagagg

SEQ ID NO: 4143 - RNA, 21 nt, Homo Sapiens
agcuggggagcagcugagaug

SEQ ID NO: 4144 - RNA, 22 nt, Homo Sapiens
agcaggacugaggacaggcccc

SEQ ID NO: 4145 - RNA, 22 nt, Homo Sapiens
acgaggcaggggcucugcuucc

SEQ ID NO: 4146 - RNA, 26 nt, Homo Sapiens
accugccuacggagggugggcucuga

SEQ ID NO: 4147 - RNA, 21 nt, Homo Sapiens
acagaggccucccccagccag

SEQ ID NO: 4148 - RNA, 22 nt, Homo Sapiens
aaaaugugaagcugaacccccu

SEQ ID NO: 4149 - RNA, 24 nt, Homo Sapiens
cagggcugugaugggcgagucccg

SEQ ID NO: 4150 - RNA, 22 nt, Homo Sapiens
ccacuggcgaagauggucucca

SEQ ID NO: 4151 - RNA, 20 nt, Homo Sapiens
ccagagacaugggccuccca

SEQ ID NO: 4152 - RNA, 23 nt, Homo Sapiens
caugacaacugaaggcaaccugg

SEQ ID NO: 4153 - RNA, 21 nt, Homo Sapiens
cccacccccaaagaccugccu

SEQ ID NO: 4154 - RNA, 24 nt, Homo Sapiens
cacuggcgaagauggucuccauau

SEQ ID NO: 4155 - RNA, 24 nt, Homo Sapiens
aucguauuauccaaauuuuguugc

SEQ ID NO: 4156 - RNA, 20 nt, Homo Sapiens
agggagcugcucagaaugcc

SEQ ID NO: 4157 - RNA, 23 nt, Homo Sapiens
augaggcuuuucccaccagcucc

SEQ ID NO: 4158 - RNA, 20 nt, Homo Sapiens
aguggggccuccuugcccag

SEQ ID NO: 4159 - RNA, 24 nt, Homo Sapiens
ugaaaccaggguagaauuguuugg

SEQ ID NO: 4160 - RNA, 25 nt, Homo Sapiens
ucuugcacggugaccccuuuuaguc

SEQ ID NO: 4161 - RNA, 20 nt, Homo Sapiens
ugagaagaaggaagaucuug

SEQ ID NO: 4162 - RNA, 27 nt, Homo Sapiens
ugaggccuuccagaaagcaggagcagc

SEQ ID NO: 4163 - RNA, 26 nt, Homo Sapiens
ugccuaggagcuggcuggcagguguu

SEQ ID NO: 4164 - RNA, 22 nt, Homo Sapiens
ugcauucacaaggugacuggga

SEQ ID NO: 4165 - RNA, 22 nt, Homo Sapiens
ugcccccguuccagcugacauc

SEQ ID NO: 4166 - RNA, 21 nt, Homo Sapiens
ugcccuugugcccugccucca

SEQ ID NO: 4167 - RNA, 26 nt, Homo Sapiens
uggccaggguagacuuggagcugucc

SEQ ID NO: 4168 - RNA, 21 nt, Homo Sapiens
uggcggggcagcaggagcggu

SEQ ID NO: 4169 - RNA, 26 nt, Homo Sapiens
ugucccccacccccaaagaccugccu

SEQ ID NO: 4170 - RNA, 23 nt, Homo Sapiens
uguacauccaaauuaaagggaaa

SEQ ID NO: 4171 - RNA, 28 nt, Homo Sapiens
ugucugguggguggagucaggcuucucu

SEQ ID NO: 4172 - RNA, 23 nt, Homo Sapiens
uguccacccucauuucugccagc

SEQ ID NO: 4173 - RNA, 22 nt, Homo Sapiens
uccucuuggagcugagaugagc

SEQ ID NO: 4174 - RNA, 23 nt, Homo Sapiens
uccucuuggagcugagaugagcc

SEQ ID NO: 4175 - RNA, 23 nt, Homo Sapiens
ucucucuuuucuucucaggauuu

SEQ ID NO: 4176 - RNA, 24 nt, Homo Sapiens
ucuauguaggugauguuuccagcu

SEQ ID NO: 4177 - RNA, 22 nt, Homo Sapiens
ucaggauuuaaaauuuaauuau

SEQ ID NO: 4178 - RNA, 24 nt, Homo Sapiens
ucccccaugugccugucacgcucu

SEQ ID NO: 4179 - RNA, 23 nt, Homo Sapiens
uccagaggggucacguguaggag

SEQ ID NO: 4180 - RNA, 21 nt, Homo Sapiens
uagcuuuuuccuggaaaagcc

SEQ ID NO: 4181 - RNA, 23 nt, Homo Sapiens
uagcuuuuuccuggaaaagcccg

SEQ ID NO: 4182 - RNA, 25 nt, Homo Sapiens
uagacacaucuauaauuuuacacac

SEQ ID NO: 4183 - RNA, 22 nt, Homo Sapiens
uaaaguauccaugcaugugcau

SEQ ID NO: 4184 - RNA, 24 nt, Homo Sapiens
guguuucuuucccaaaaugugccu

SEQ ID NO: 4185 - RNA, 23 nt, Homo Sapiens
guuguugccagguugcagcugcu

SEQ ID NO: 4186 - RNA, 26 nt, Homo Sapiens
guugcagcugcucuugcaucugggcc

SEQ ID NO: 4187 - RNA, 23 nt, Homo Sapiens
uguugccagguugcagcugcucu

SEQ ID NO: 4188 - RNA, 24 nt, Homo Sapiens
uuccagcugacaucuugcacggug

SEQ ID NO: 4189 - RNA, 22 nt, Homo Sapiens
uucucccuucucucuuuucuuc

SEQ ID NO: 4190 - RNA, 27 nt, Homo Sapiens
uucucccuucucucuuuucuucucagg

SEQ ID NO: 4191 - RNA, 20 nt, Homo Sapiens
uuuagucaggagagugcaga

SEQ ID NO: 4192 - RNA, 25 nt, Homo Sapiens
uugcgggguggagugagguuaguuc

SEQ ID NO: 4193 - RNA, 25 nt, Homo Sapiens
uugcagcugcucuugcaucugggcc

SEQ ID NO: 4194 - RNA, 22 nt, Homo Sapiens
uugcccaggucucacugcuuug

SEQ ID NO: 4195 - RNA, 27 nt, Homo Sapiens
uugcccaggucucacugcuuugcaccg

SEQ ID NO: 4196 - RNA, 20 nt, Homo Sapiens
uuucagcugugagcuuucug

SEQ ID NO: 4197 - RNA, 25 nt, Homo Sapiens
uucucagaagugaaaaagacuucaa

SEQ ID NO: 4198 - RNA, 24 nt, Homo Sapiens
uguucugacagcauuucagcugug

SEQ ID NO: 4199 - RNA, 24 nt, Homo Sapiens
uucacaccacugccauuuccuccu

SEQ ID NO: 4200 - RNA, 21 nt, Homo Sapiens
ugguagaguccuaggacaucu

SEQ ID NO: 4201 - RNA, 23 nt, Homo Sapiens
ugcuggcauuugcugcauuucaa

SEQ ID NO: 4202 - RNA, 17 nt, Homo Sapiens
uggaaaccuugcugcua

SEQ ID NO: 4203 - RNA, 25 nt, Homo Sapiens
ugcuucucuaaaacagcacuaucga

SEQ ID NO: 4204 - RNA, 21 nt, Homo Sapiens
ugagccaaguucacaccacug

SEQ ID NO: 4205 - RNA, 22 nt, Homo Sapiens
ugcagugagccaaguucacacc

SEQ ID NO: 4206 - RNA, 22 nt, Homo Sapiens
ugcauguaauccuagcacuuug

SEQ ID NO: 4207 - RNA, 25 nt, Homo Sapiens
uuuugaaauauucacaagguugcug

SEQ ID NO: 4208 - RNA, 21 nt, Homo Sapiens
aguguuacagaguguggguac

SEQ ID NO: 4209 - RNA, 27 nt, Homo Sapiens
aggcucgugcauguaauccuagcacuu

SEQ ID NO: 4210 - RNA, 22 nt, Homo Sapiens
aggcugagacgcaaggaucacu

SEQ ID NO: 4211 - RNA, 22 nt, Homo Sapiens
aggcugagaugggaggaucacu

SEQ ID NO: 4212 - RNA, 29 nt, Homo Sapiens
augggaggaucacuugaggccaagaguuu

SEQ ID NO: 4213 - RNA, 26 nt, Homo Sapiens
auugcugcuuucucuucuacuucuug

SEQ ID NO: 4214 - RNA, 22 nt, Homo Sapiens
cagaagcucaaggcugcaguga

SEQ ID NO: 4215 - RNA, 23 nt, Homo Sapiens
cacugccauuuccuccugggcaa

SEQ ID NO: 4216 - RNA, 23 nt, Homo Sapiens
caccacugccauuuccuccuggg

SEQ ID NO: 4217 - RNA, 19 nt, Homo Sapiens
caaggugaauggugagcag

SEQ ID NO: 4218 - RNA, 19 nt, Homo Sapiens
ccagaagcucaaggcugca

SEQ ID NO: 4219 - RNA, 23 nt, Homo Sapiens
ccagaagcucaaggcugcaguga

SEQ ID NO: 4220 - RNA, 22 nt, Homo Sapiens
aaaauguucugacagcauuuca

SEQ ID NO: 4221 - RNA, 21 nt, Homo Sapiens
aaauguucugacagcauuuca

SEQ ID NO: 4222 - RNA, 13 nt, Homo Sapiens
accaaaugccuuu

SEQ ID NO: 4223 - RNA, 27 nt, Homo Sapiens
acuauugcugcuuucucuucuacuucu

SEQ ID NO: 4224 - RNA, 19 nt, Homo Sapiens
acugccauuuccuccuggg

SEQ ID NO: 4225 - RNA, 22 nt, Homo Sapiens
agaccaaccuggguaacaaagu

SEQ ID NO: 4226 - RNA, 22 nt, Homo Sapiens
cuguggucccagcuacagggga

SEQ ID NO: 4227 - RNA, 25 nt, Homo Sapiens
gcaauugcuucucuaaaacagcacu

SEQ ID NO: 4228 - RNA, 20 nt, Homo Sapiens
cucagguuuccggcuacuga

SEQ ID NO: 4229 - RNA, 25 nt, Homo Sapiens
gccguggcaacuguggaaggcacac

SEQ ID NO: 4230 - RNA, 21 nt, Homo Sapiens
gcagugagccaaguucacacc

SEQ ID NO: 4231 - RNA, 22 nt, Homo Sapiens
gcauguaauccuagcacuuugg

SEQ ID NO: 4232 - RNA, 22 nt, Homo Sapiens
ggaggcugagacgcaaggauca

SEQ ID NO: 4233 - RNA, 22 nt, Homo Sapiens
ggaggcugagaugggaggauca

SEQ ID NO: 4234 - RNA, 21 nt, Homo Sapiens
ggugacuuuccuaugacacuc

SEQ ID NO: 4235 - RNA, 20 nt, Homo Sapiens
gguauuugguaacuugcugu

SEQ ID NO: 4236 - RNA, 21 nt, Homo Sapiens
ggcucgugcauguaauccuag

SEQ ID NO: 4237 - RNA, 25 nt, Homo Sapiens
ggcagaaccuagucuuguuguucau

SEQ ID NO: 4238 - RNA, 21 nt, Homo Sapiens
gguuuugaucucagcauccug

SEQ ID NO: 4239 - RNA, 20 nt, Homo Sapiens
gucagugagucagaggcaga

SEQ ID NO: 4240 - RNA, 20 nt, Homo Sapiens
gcuuugcaaccuuguacuuu

SEQ ID NO: 4241 - RNA, 23 nt, Homo Sapiens
gcugcagcuaauuugugaaagug

SEQ ID NO: 4242 - RNA, 20 nt, Homo Sapiens
cucacagcacauuuguuaau

SEQ ID NO: 4243 - RNA, 27 nt, Homo Sapiens
cgcuaguggguuaucagcuaacacccg

SEQ ID NO: 4244 - RNA, 21 nt, Homo Sapiens
ccuuugucaaaugguauuuuu

SEQ ID NO: 4245 - RNA, 22 nt, Homo Sapiens
ccuuucucucuuucuuuugugc

SEQ ID NO: 4246 - RNA, 24 nt, Homo Sapiens
ccugccuugccccuuaccugccga

SEQ ID NO: 4247 - RNA, 29 nt, Homo Sapiens
ccgccgaggcgcgagguugcggcgcgcag

SEQ ID NO: 4248 - RNA, 23 nt, Homo Sapiens
gauugcuagccuuggcugcucca

SEQ ID NO: 4249 - RNA, 21 nt, Homo Sapiens
gaagaagaaagaagacgcgau

SEQ ID NO: 4250 - RNA, 20 nt, Homo Sapiens
gaaguagugugaguguuaga

SEQ ID NO: 4251 - RNA, 24 nt, Homo Sapiens
gacgccauccuucaaaaacaacua

SEQ ID NO: 4252 - RNA, 21 nt, Homo Sapiens
cuuacacaccugagaaugugc

SEQ ID NO: 4253 - RNA, 23 nt, Homo Sapiens
cuucaaaaacaacuaaaggauga

SEQ ID NO: 4254 - RNA, 26 nt, Homo Sapiens
cugccuggucuuccucccggacgcua

SEQ ID NO: 4255 - RNA, 20 nt, Homo Sapiens
agcuuugcaaccuuguacuu

SEQ ID NO: 4256 - RNA, 22 nt, Homo Sapiens
aggacugaagaaaauccuucag

SEQ ID NO: 4257 - RNA, 20 nt, Homo Sapiens
aauuaaaaagacacuuuuac

SEQ ID NO: 4258 - RNA, 23 nt, Homo Sapiens
acacaguaagauagguucugcuu

SEQ ID NO: 4259 - RNA, 24 nt, Homo Sapiens
acaaguguuucuaguaacaguauu

SEQ ID NO: 4260 - RNA, 26 nt, Homo Sapiens
acaaguguuucuaguaacaguauuuc

SEQ ID NO: 4261 - RNA, 22 nt, Homo Sapiens
aaggauuagcaguguguggaaa

SEQ ID NO: 4262 - RNA, 21 nt, Homo Sapiens
aauauaaaucacagauuucca

SEQ ID NO: 4263 - RNA, 26 nt, Homo Sapiens
aacauagugguauuuuaacauagcag

SEQ ID NO: 4264 - RNA, 22 nt, Homo Sapiens
caugcauucagaucugaaguag

SEQ ID NO: 4265 - RNA, 19 nt, Homo Sapiens
cagcauccuggaaauuugu

SEQ ID NO: 4266 - RNA, 20 nt, Homo Sapiens
cagcauccuggaaauuugug

SEQ ID NO: 4267 - RNA, 25 nt, Homo Sapiens
cagcauccuggaaauuugugugcuu

SEQ ID NO: 4268 - RNA, 27 nt, Homo Sapiens
ccgaggcgcgagguugcggcgcgcagc

SEQ ID NO: 4269 - RNA, 22 nt, Homo Sapiens
cacacaacuguggauaaauuuu

SEQ ID NO: 4270 - RNA, 24 nt, Homo Sapiens
aggcgcgagguugcggcgcgcagc

SEQ ID NO: 4271 - RNA, 22 nt, Homo Sapiens
agucaagucuaccugccuugcc

SEQ ID NO: 4272 - RNA, 23 nt, Homo Sapiens
aguugaaugauaauagcucacag

SEQ ID NO: 4273 - RNA, 24 nt, Homo Sapiens
aucgcgccgagcucccuccauucc

SEQ ID NO: 4274 - RNA, 22 nt, Homo Sapiens
ugaguguuagaaaaaacuggaa

SEQ ID NO: 4275 - RNA, 16 nt, Homo Sapiens
ugccccuuaccugccg

SEQ ID NO: 4276 - RNA, 23 nt, Homo Sapiens
ucuucugucuguacaucguuguc

SEQ ID NO: 4277 - RNA, 21 nt, Homo Sapiens
uggaaacaucugauuucugaa

SEQ ID NO: 4278 - RNA, 20 nt, Homo Sapiens
guuuugaucucagcauccug

SEQ ID NO: 4279 - RNA, 25 nt, Homo Sapiens
uacaaguguuucuaguaacaguauu

SEQ ID NO: 4280 - RNA, 27 nt, Homo Sapiens
uacaaguguuucuaguaacaguauuuc

SEQ ID NO: 4281 - RNA, 19 nt, Homo Sapiens
ucagugagucagaggcaga

SEQ ID NO: 4282 - RNA, 22 nt, Homo Sapiens
ugugugcagaguauacaagugu

SEQ ID NO: 4283 - RNA, 23 nt, Homo Sapiens
uucuugcucugcucaucuacaca

SEQ ID NO: 4284 - RNA, 20 nt, Homo Sapiens
uuguacuuuacaaucaugcc

SEQ ID NO: 4285 - RNA, 24 nt, Homo Sapiens
uuugguugcuuaagacugaagcaa

SEQ ID NO: 4286 - RNA, 21 nt, Homo Sapiens
uuuguugugcuugcugguacu

SEQ ID NO: 4287 - RNA, 23 nt, Homo Sapiens
uucauuguguguuagcagcagug

SEQ ID NO: 4288 - RNA, 23 nt, Homo Sapiens
ugugccuguaaucccagcuacuc

SEQ ID NO: 4289 - RNA, 27 nt, Homo Sapiens
ugucuucaauuaaaagaccacagacuu

SEQ ID NO: 4290 - RNA, 21 nt, Homo Sapiens
uccagccuggguggcagagug

SEQ ID NO: 4291 - RNA, 19 nt, Homo Sapiens
uaaggacaauguaacucua

SEQ ID NO: 4292 - RNA, 25 nt, Homo Sapiens
uggugacaugugccuguaaucccag

SEQ ID NO: 4293 - RNA, 27 nt, Homo Sapiens
ugaccaacguggugaaacccugucucu

SEQ ID NO: 4294 - RNA, 23 nt, Homo Sapiens
ugccuguaaucccagcuacucag

SEQ ID NO: 4295 - RNA, 27 nt, Homo Sapiens
ugccuguaaucccagcuacucaggagg

SEQ ID NO: 4296 - RNA, 22 nt, Homo Sapiens
ugccuguagucccggcacuuug

SEQ ID NO: 4297 - RNA, 22 nt, Homo Sapiens
aucgcuugaacccaggaggcgg

SEQ ID NO: 4298 - RNA, 21 nt, Homo Sapiens
aguggcuuucagcaaaccuca

SEQ ID NO: 4299 - RNA, 22 nt, Homo Sapiens
aggcuaaggcaggagaaucgcu

SEQ ID NO: 4300 - RNA, 22 nt, Homo Sapiens
cacaaggucaggaguucgagac

SEQ ID NO: 4301 - RNA, 22 nt, Homo Sapiens
caccacugcacuccagccuggg

SEQ ID NO: 4302 - RNA, 22 nt, Homo Sapiens
cacugcacuccagccugggugg

SEQ ID NO: 4303 - RNA, 23 nt, Homo Sapiens
auugcaccacugcacuccagccu

SEQ ID NO: 4304 - RNA, 23 nt, Homo Sapiens
augggcauccugaagcugcaagu

SEQ ID NO: 4305 - RNA, 23 nt, Homo Sapiens
cccaggaggcggagguugcagug

SEQ ID NO: 4306 - RNA, 21 nt, Homo Sapiens
ccagccuggguggcagaguga

SEQ ID NO: 4307 - RNA, 22 nt, Homo Sapiens
ccaggaggcggagguugcagug

SEQ ID NO: 4308 - RNA, 23 nt, Homo Sapiens
ccaggaggcggagguugcaguga

SEQ ID NO: 4309 - RNA, 21 nt, Homo Sapiens
caggaggcggagguugcagug

SEQ ID NO: 4310 - RNA, 22 nt, Homo Sapiens
caggaggcggagguugcaguga

SEQ ID NO: 4311 - RNA, 22 nt, Homo Sapiens
ccaacguggugaaacccugucu

SEQ ID NO: 4312 - RNA, 22 nt, Homo Sapiens
ccacugcacuccagccugggug

SEQ ID NO: 4313 - RNA, 21 nt, Homo Sapiens
aaggucaggaguucgagacca

SEQ ID NO: 4314 - RNA, 22 nt, Homo Sapiens
aagcaaauuaguaauugucaau

SEQ ID NO: 4315 - RNA, 22 nt, Homo Sapiens
accagccugaccaacgugguga

SEQ ID NO: 4316 - RNA, 22 nt, Homo Sapiens
acuccagccuggguggcagagu

SEQ ID NO: 4317 - RNA, 20 nt, Homo Sapiens
accuauaucucaguggcaca

SEQ ID NO: 4318 - RNA, 21 nt, Homo Sapiens
aggaggcggagguugcaguga

SEQ ID NO: 4319 - RNA, 22 nt, Homo Sapiens
aggccgaggcaggcagaucaca

SEQ ID NO: 4320 - RNA, 22 nt, Homo Sapiens
agaccagccugaccaacguggu

SEQ ID NO: 4321 - RNA, 21 nt, Homo Sapiens
agaaaauuaguaauuguaagu

SEQ ID NO: 4322 - RNA, 28 nt, Homo Sapiens
agauugcaccacugcacuccagccuggg

SEQ ID NO: 4323 - RNA, 22 nt, Homo Sapiens
cuuucagcaaaccucagucaua

SEQ ID NO: 4324 - RNA, 22 nt, Homo Sapiens
gaacccaggaggcggagguugc

SEQ ID NO: 4325 - RNA, 22 nt, Homo Sapiens
gaccagccugaccaacguggug

SEQ ID NO: 4326 - RNA, 22 nt, Homo Sapiens
ccuguaaucccagcuacucagg

SEQ ID NO: 4327 - RNA, 21 nt, Homo Sapiens
ccuguagucccggcacuuugg

SEQ ID NO: 4328 - RNA, 22 nt, Homo Sapiens
cuaaggcaggagaaucgcuuga

SEQ ID NO: 4329 - RNA, 20 nt, Homo Sapiens
ggaggcggagguugcaguga

SEQ ID NO: 4330 - RNA, 21 nt, Homo Sapiens
ggaggcggagguugcagugag

SEQ ID NO: 4331 - RNA, 22 nt, Homo Sapiens
gccuguagucccggcacuuugg

SEQ ID NO: 4332 - RNA, 23 nt, Homo Sapiens
gccuguaaucccagcuacucagg

SEQ ID NO: 4333 - RNA, 20 nt, Homo Sapiens
guggcuuucagcaaaccuca

SEQ ID NO: 4334 - RNA, 22 nt, Homo Sapiens
ggcaggagaaucgcuugaaccc

SEQ ID NO: 4335 - RNA, 24 nt, Homo Sapiens
cggugaucccggcgacugcgcugg

SEQ ID NO: 4336 - RNA, 27 nt, Homo Sapiens
agagccuaagaaaaucaucuuggccac

SEQ ID NO: 4337 - RNA, 23 nt, Homo Sapiens
aagaaaaucaucuuggccacuuu

SEQ ID NO: 4338 - RNA, 20 nt, Homo Sapiens
aaggagcaaccaaaauguca

SEQ ID NO: 4339 - RNA, 26 nt, Homo Sapiens
aacaucuucaguuuuucucccacugg

SEQ ID NO: 4340 - RNA, 24 nt, Homo Sapiens
aaccggagcugaauuaccuuucac

SEQ ID NO: 4341 - RNA, 27 nt, Homo Sapiens
aaccggagcugaauuaccuuucacuuu

SEQ ID NO: 4342 - RNA, 22 nt, Homo Sapiens
aacucucaguccaacauuauuu

SEQ ID NO: 4343 - RNA, 27 nt, Homo Sapiens
aacuauacaucauuuuugcccucugcc

SEQ ID NO: 4344 - RNA, 22 nt, Homo Sapiens
aacaccauccauuugggaaaga

SEQ ID NO: 4345 - RNA, 22 nt, Homo Sapiens
aaauugcugggauuacaggcau

SEQ ID NO: 4346 - RNA, 27 nt, Homo Sapiens
aaagaacaguaaacauugguaagaaug

SEQ ID NO: 4347 - RNA, 24 nt, Homo Sapiens
aaacaguauguaaaacucuguuuu

SEQ ID NO: 4348 - RNA, 26 nt, Homo Sapiens
aaacuuagcaaaauuagcaauauauu

SEQ ID NO: 4349 - RNA, 23 nt, Homo Sapiens
agauagauggcuuaauaaaauag

SEQ ID NO: 4350 - RNA, 21 nt, Homo Sapiens
agagucuggccaaaacgguaa

SEQ ID NO: 4351 - RNA, 20 nt, Homo Sapiens
agagauuggugaauugaaug

SEQ ID NO: 4352 - RNA, 26 nt, Homo Sapiens
acuuucaaaaacaugaccuuccacaa

SEQ ID NO: 4353 - RNA, 31 nt, Homo Sapiens
agaauaaaagauguagcacauuuugcuuucc

SEQ ID NO: 4354 - RNA, 22 nt, Homo Sapiens
agccuccugaguagcugggauu

SEQ ID NO: 4355 - RNA, 22 nt, Homo Sapiens
agccucccaaauugcugggauu

SEQ ID NO: 4356 - RNA, 22 nt, Homo Sapiens
acccauucauagcauagcuaga

SEQ ID NO: 4357 - RNA, 24 nt, Homo Sapiens
accuugugauuugcccgccucagc

SEQ ID NO: 4358 - RNA, 24 nt, Homo Sapiens
acucauagcaaagucacuucuguu

SEQ ID NO: 4359 - RNA, 22 nt, Homo Sapiens
acucaaacuccugaccuuguga

SEQ ID NO: 4360 - RNA, 26 nt, Homo Sapiens
acucacugacucuucuaugcaguuac

SEQ ID NO: 4361 - RNA, 25 nt, Homo Sapiens
acugucccccaggcuggagugcagu

SEQ ID NO: 4362 - RNA, 27 nt, Homo Sapiens
acucuucuaugcaguuacuacauaucu

SEQ ID NO: 4363 - RNA, 22 nt, Homo Sapiens
acugcaaccuccaccuccuggg

SEQ ID NO: 4364 - RNA, 26 nt, Homo Sapiens
accacuaugcccggcuaauuuuuugg

SEQ ID NO: 4365 - RNA, 20 nt, Homo Sapiens
acacuuuucaaaauaugugg

SEQ ID NO: 4366 - RNA, 23 nt, Homo Sapiens
acaaguauuuuaacucucagucc

SEQ ID NO: 4367 - RNA, 23 nt, Homo Sapiens
aauucagagcagauuagagccug

SEQ ID NO: 4368 - RNA, 21 nt, Homo Sapiens
aauugcugggauuacaggcau

SEQ ID NO: 4369 - RNA, 25 nt, Homo Sapiens
aauauuaucuuucuuaacuuuuucc

SEQ ID NO: 4370 - RNA, 22 nt, Homo Sapiens
ccaccuccuggguuuaagcgau

SEQ ID NO: 4371 - RNA, 22 nt, Homo Sapiens
ccaaauugcugggauuacaggc

SEQ ID NO: 4372 - RNA, 19 nt, Homo Sapiens
caucugccagcugugucau

SEQ ID NO: 4373 - RNA, 20 nt, Homo Sapiens
cauggacucaccacugugug

SEQ ID NO: 4374 - RNA, 22 nt, Homo Sapiens
caggcuggagugcaguggcaug

SEQ ID NO: 4375 - RNA, 27 nt, Homo Sapiens
caggcuggagugcaguggcaugaucuc

SEQ ID NO: 4376 - RNA, 21 nt, Homo Sapiens
caguuuuucucccacuggguc

SEQ ID NO: 4377 - RNA, 20 nt, Homo Sapiens
cauaaaguccagaucuggua

SEQ ID NO: 4378 - RNA, 20 nt, Homo Sapiens
cauaauccucuccaacugga

SEQ ID NO: 4379 - RNA, 19 nt, Homo Sapiens
ccaggcuggagugcagugg

SEQ ID NO: 4380 - RNA, 22 nt, Homo Sapiens
cccaaauugcugggauuacagg

SEQ ID NO: 4381 - RNA, 22 nt, Homo Sapiens
ccccaggcuggagugcaguggc

SEQ ID NO: 4382 - RNA, 25 nt, Homo Sapiens
ccccaggcuggagugcaguggcaug

SEQ ID NO: 4383 - RNA, 20 nt, Homo Sapiens
cccccaggcuggagugcagu

SEQ ID NO: 4384 - RNA, 21 nt, Homo Sapiens
cccccaggcuggagugcagug

SEQ ID NO: 4385 - RNA, 22 nt, Homo Sapiens
cccccaggcuggagugcagugg

SEQ ID NO: 4386 - RNA, 17 nt, Homo Sapiens
cccucugccuguuuucc

SEQ ID NO: 4387 - RNA, 22 nt, Homo Sapiens
augugggaagcauuugauuuuc

SEQ ID NO: 4388 - RNA, 22 nt, Homo Sapiens
auucaaaucacauggcuuucca

SEQ ID NO: 4389 - RNA, 24 nt, Homo Sapiens
auucugcccccaucccaacccagc

SEQ ID NO: 4390 - RNA, 23 nt, Homo Sapiens
auugguaagaaugagcuuucaac

SEQ ID NO: 4391 - RNA, 21 nt, Homo Sapiens
caaccaaaacuuuacaagcuu

SEQ ID NO: 4392 - RNA, 27 nt, Homo Sapiens
caaccaaaaugucacaaccaaaacuuu

SEQ ID NO: 4393 - RNA, 22 nt, Homo Sapiens
cacucacugacucuucuaugca

SEQ ID NO: 4394 - RNA, 27 nt, Homo Sapiens
cacugucccccaggcuggagugcagug

SEQ ID NO: 4395 - RNA, 22 nt, Homo Sapiens
cacuucaccucucugugccuca

SEQ ID NO: 4396 - RNA, 21 nt, Homo Sapiens
caccuccuggguuuaagcgau

SEQ ID NO: 4397 - RNA, 22 nt, Homo Sapiens
caccuccuggguuuaagcgauu

SEQ ID NO: 4398 - RNA, 21 nt, Homo Sapiens
cacauggcuuuccaccaauau

SEQ ID NO: 4399 - RNA, 27 nt, Homo Sapiens
cacaaugauuccuucuuuucuaggcaa

SEQ ID NO: 4400 - RNA, 22 nt, Homo Sapiens
caaguauuuuaacucucagucc

SEQ ID NO: 4401 - RNA, 26 nt, Homo Sapiens
caauauuaucuuucuuaacuuuuucc

SEQ ID NO: 4402 - RNA, 23 nt, Homo Sapiens
aggcuggagugcaguggcaugau

SEQ ID NO: 4403 - RNA, 22 nt, Homo Sapiens
aguaaacauuccaacauugucu

SEQ ID NO: 4404 - RNA, 22 nt, Homo Sapiens
aguggcaugaucucggcucacu

SEQ ID NO: 4405 - RNA, 22 nt, Homo Sapiens
aguuuaugccccucccuugcaa

SEQ ID NO: 4406 - RNA, 20 nt, Homo Sapiens
aguuuuucucccacuggguc

SEQ ID NO: 4407 - RNA, 22 nt, Homo Sapiens
augaucucggcucacugcaacc

SEQ ID NO: 4408 - RNA, 22 nt, Homo Sapiens
cgggcuguuuguuuuacagugu

SEQ ID NO: 4409 - RNA, 25 nt, Homo Sapiens
cucauguauuuuuaucacacuuaua

SEQ ID NO: 4410 - RNA, 22 nt, Homo Sapiens
cucagccucccaaauugcuggg

SEQ ID NO: 4411 - RNA, 20 nt, Homo Sapiens
cucucaguccaacauuauuu

SEQ ID NO: 4412 - RNA, 27 nt, Homo Sapiens
cuccugaccuugugauuugcccgccuc

SEQ ID NO: 4413 - RNA, 22 nt, Homo Sapiens
cucuggauuuccuuuugcuuca

SEQ ID NO: 4414 - RNA, 26 nt, Homo Sapiens
cucuccucagaagaaagaaucuuucc

SEQ ID NO: 4415 - RNA, 22 nt, Homo Sapiens
cugaguagcugggauuacaggc

SEQ ID NO: 4416 - RNA, 22 nt, Homo Sapiens
ccugaguagcugggauuacagg

SEQ ID NO: 4417 - RNA, 26 nt, Homo Sapiens
ccuccaccuccuggguuuaagcgauu

SEQ ID NO: 4418 - RNA, 22 nt, Homo Sapiens
gacacaaaaguccacugaugca

SEQ ID NO: 4419 - RNA, 26 nt, Homo Sapiens
gacucugaaaccucaagcugucuacu

SEQ ID NO: 4420 - RNA, 21 nt, Homo Sapiens
gcaaccuccaccuccuggguu

SEQ ID NO: 4421 - RNA, 24 nt, Homo Sapiens
gcaaaaacuuccaucacaacaaga

SEQ ID NO: 4422 - RNA, 27 nt, Homo Sapiens
gauuacaucauguauuuugccucaugu

SEQ ID NO: 4423 - RNA, 24 nt, Homo Sapiens
gcaauaugucaucuaccuaccuca

SEQ ID NO: 4424 - RNA, 22 nt, Homo Sapiens
gcaccuugcaaaaaugguccug

SEQ ID NO: 4425 - RNA, 25 nt, Homo Sapiens
gaguccagagaggaaacuguggaau

SEQ ID NO: 4426 - RNA, 27 nt, Homo Sapiens
gaguagcugggauuacaggcacccacc

SEQ ID NO: 4427 - RNA, 25 nt, Homo Sapiens
gaaagagauggcuaacaaucuguga

SEQ ID NO: 4428 - RNA, 22 nt, Homo Sapiens
cuuuauuuuuccacaucaugcu

SEQ ID NO: 4429 - RNA, 21 nt, Homo Sapiens
cuucaccucucugugccucag

SEQ ID NO: 4430 - RNA, 22 nt, Homo Sapiens
cuuaauguucaaaaugacuugg

SEQ ID NO: 4431 - RNA, 27 nt, Homo Sapiens
cugugugaccuugggcaagucacuuca

SEQ ID NO: 4432 - RNA, 21 nt, Homo Sapiens
cuuagaauaaaagauguagca

SEQ ID NO: 4433 - RNA, 19 nt, Homo Sapiens
cuuagcaauguucuaauca

SEQ ID NO: 4434 - RNA, 22 nt, Homo Sapiens
cugcaaccuccaccuccugggu

SEQ ID NO: 4435 - RNA, 22 nt, Homo Sapiens
cugugccucaguuuccucaucu

SEQ ID NO: 4436 - RNA, 21 nt, Homo Sapiens
cugucccccaggcuggagugc

SEQ ID NO: 4437 - RNA, 24 nt, Homo Sapiens
cugucccccaggcuggagugcagu

SEQ ID NO: 4438 - RNA, 25 nt, Homo Sapiens
cugucccccaggcuggagugcagug

SEQ ID NO: 4439 - RNA, 22 nt, Homo Sapiens
ggcaagucacuucaccucucug

SEQ ID NO: 4440 - RNA, 25 nt, Homo Sapiens
ggcaauauaaggaaagugauccaaa

SEQ ID NO: 4441 - RNA, 25 nt, Homo Sapiens
ggcaauaugucaucuaccuaccuca

SEQ ID NO: 4442 - RNA, 23 nt, Homo Sapiens
ggcuaauuuuuuggauuuuuaau

SEQ ID NO: 4443 - RNA, 21 nt, Homo Sapiens
ggcucacugcaaccuccaccu

SEQ ID NO: 4444 - RNA, 22 nt, Homo Sapiens
ggcucacugcaaccuccaccuc

SEQ ID NO: 4445 - RNA, 22 nt, Homo Sapiens
gggauuacaggcaugagccacc

SEQ ID NO: 4446 - RNA, 27 nt, Homo Sapiens
ggggcaauaugucaucuaccuaccuca

SEQ ID NO: 4447 - RNA, 24 nt, Homo Sapiens
gugcaaccuaauuaguaacuuucc

SEQ ID NO: 4448 - RNA, 22 nt, Homo Sapiens
gucccccaggcuggagugcagu

SEQ ID NO: 4449 - RNA, 23 nt, Homo Sapiens
gucccccaggcuggagugcagug

SEQ ID NO: 4450 - RNA, 22 nt, Homo Sapiens
gggguuuuaccauguuggccag

SEQ ID NO: 4451 - RNA, 22 nt, Homo Sapiens
gcaugagccaccacacccugcc

SEQ ID NO: 4452 - RNA, 27 nt, Homo Sapiens
gcacugucccccaggcuggagugcagu

SEQ ID NO: 4453 - RNA, 22 nt, Homo Sapiens
gcacuugggagaaggcuuagaa

SEQ ID NO: 4454 - RNA, 24 nt, Homo Sapiens
gcagaaggcuaggaauuuuagcag

SEQ ID NO: 4455 - RNA, 23 nt, Homo Sapiens
gcuuuauuuuuccacaucaugcu

SEQ ID NO: 4456 - RNA, 22 nt, Homo Sapiens
ggaacaaugcuuuuguuuuuua

SEQ ID NO: 4457 - RNA, 22 nt, Homo Sapiens
ggacucaaacuccugaccuugu

SEQ ID NO: 4458 - RNA, 27 nt, Homo Sapiens
ggacucaaacuccugaccuugugauuu

SEQ ID NO: 4459 - RNA, 22 nt, Homo Sapiens
gcucacugcaaccuccaccucc

SEQ ID NO: 4460 - RNA, 21 nt, Homo Sapiens
gcuccaggguuucuguuacua

SEQ ID NO: 4461 - RNA, 17 nt, Homo Sapiens
ugcccaaaaugcacuga

SEQ ID NO: 4462 - RNA, 23 nt, Homo Sapiens
ugaguagcugggauuacaggcac

SEQ ID NO: 4463 - RNA, 22 nt, Homo Sapiens
ugcaaccuccaccuccuggguu

SEQ ID NO: 4464 - RNA, 29 nt, Homo Sapiens
ugcaggagggacucugaaaccucaagcug

SEQ ID NO: 4465 - RNA, 28 nt, Homo Sapiens
ucuuuauucugcccccaucccaacccag

SEQ ID NO: 4466 - RNA, 23 nt, Homo Sapiens
ucuuuuaucugugucuguguauc

SEQ ID NO: 4467 - RNA, 24 nt, Homo Sapiens
ucuuuuaucugugucuguguauca

SEQ ID NO: 4468 - RNA, 20 nt, Homo Sapiens
ugguccuggaguugguagau

SEQ ID NO: 4469 - RNA, 27 nt, Homo Sapiens
uggguuuaagcgauucuccugccucag

SEQ ID NO: 4470 - RNA, 22 nt, Homo Sapiens
ugggauuacaggcaugagccac

SEQ ID NO: 4471 - RNA, 20 nt, Homo Sapiens
ugucccccaggcuggagugc

SEQ ID NO: 4472 - RNA, 22 nt, Homo Sapiens
ugucccccaggcuggagugcag

SEQ ID NO: 4473 - RNA, 23 nt, Homo Sapiens
ugucccccaggcuggagugcagu

SEQ ID NO: 4474 - RNA, 24 nt, Homo Sapiens
ugucccccaggcuggagugcagug

SEQ ID NO: 4475 - RNA, 27 nt, Homo Sapiens
uggaauaaaguccucaaaauugaaaug

SEQ ID NO: 4476 - RNA, 23 nt, Homo Sapiens
ugcuggagccauucauucagcaa

SEQ ID NO: 4477 - RNA, 20 nt, Homo Sapiens
ugcucuguggcuccaggguu

SEQ ID NO: 4478 - RNA, 22 nt, Homo Sapiens
uggacucaaacuccugaccuug

SEQ ID NO: 4479 - RNA, 27 nt, Homo Sapiens
uggacucaaacuccugaccuugugauu

SEQ ID NO: 4480 - RNA, 20 nt, Homo Sapiens
uggagccagcaauccuguuc

SEQ ID NO: 4481 - RNA, 22 nt, Homo Sapiens
uacuaguccaucauagccuaga

SEQ ID NO: 4482 - RNA, 21 nt, Homo Sapiens
uacugaaaacaccauccauuu

SEQ ID NO: 4483 - RNA, 17 nt, Homo Sapiens
uaaaagaguuaaugaac

SEQ ID NO: 4484 - RNA, 22 nt, Homo Sapiens
uaacaucuucaguuuuucuccc

SEQ ID NO: 4485 - RNA, 21 nt, Homo Sapiens
uaggagugauuugcaccuugc

SEQ ID NO: 4486 - RNA, 23 nt, Homo Sapiens
uagauccaguugcacuaaauucc

SEQ ID NO: 4487 - RNA, 26 nt, Homo Sapiens
uauacagucuuuaugaauuucuuaau

SEQ ID NO: 4488 - RNA, 26 nt, Homo Sapiens
uauucccucucaacaaaacuuuauag

SEQ ID NO: 4489 - RNA, 27 nt, Homo Sapiens
ucagauuucauagaaaggagcaaccaa

SEQ ID NO: 4490 - RNA, 24 nt, Homo Sapiens
ucagaucuuucuagucaccuuaga

SEQ ID NO: 4491 - RNA, 18 nt, Homo Sapiens
ucagaucuuuuugguaaa

SEQ ID NO: 4492 - RNA, 22 nt, Homo Sapiens
ucccccaggcuggagugcagug

SEQ ID NO: 4493 - RNA, 18 nt, Homo Sapiens
ucccacugggucaccuca

SEQ ID NO: 4494 - RNA, 27 nt, Homo Sapiens
uccagagaggaaacuguggaauggaaa

SEQ ID NO: 4495 - RNA, 23 nt, Homo Sapiens
ucaugcaaauucuauauuuuaca

SEQ ID NO: 4496 - RNA, 23 nt, Homo Sapiens
ucauuuucagacuuuguacuuca

SEQ ID NO: 4497 - RNA, 27 nt, Homo Sapiens
ucucaacaaaacuuuauaggcagucuu

SEQ ID NO: 4498 - RNA, 22 nt, Homo Sapiens
ucucccacugggucaccucaag

SEQ ID NO: 4499 - RNA, 22 nt, Homo Sapiens
ucucccaucucucuggauuucc

SEQ ID NO: 4500 - RNA, 22 nt, Homo Sapiens
ucucucuggauuuccuuuugcu

SEQ ID NO: 4501 - RNA, 19 nt, Homo Sapiens
uccucuuuuuauuuuuucc

SEQ ID NO: 4502 - RNA, 21 nt, Homo Sapiens
uguguagaugaaaccaucuca

SEQ ID NO: 4503 - RNA, 21 nt, Homo Sapiens
uuagguauuagaaagugauac

SEQ ID NO: 4504 - RNA, 22 nt, Homo Sapiens
uucaaugcuaguguuuaauccu

SEQ ID NO: 4505 - RNA, 21 nt, Homo Sapiens
uuacucuuauucuuagcugua

SEQ ID NO: 4506 - RNA, 23 nt, Homo Sapiens
uuagcacucacugacucuucuau

SEQ ID NO: 4507 - RNA, 21 nt, Homo Sapiens
uuauuuuaaaacagaagaauu

SEQ ID NO: 4508 - RNA, 21 nt, Homo Sapiens
uucauaaccuuuauauuugcc

SEQ ID NO: 4509 - RNA, 19 nt, Homo Sapiens
uucacuuucaaaaacauga

SEQ ID NO: 4510 - RNA, 22 nt, Homo Sapiens
uucagaucuuucuagucaccuu

SEQ ID NO: 4511 - RNA, 21 nt, Homo Sapiens
uucucucuugcccaaauaaua

SEQ ID NO: 4512 - RNA, 22 nt, Homo Sapiens
uucuauaaauaacccauucaua

SEQ ID NO: 4513 - RNA, 25 nt, Homo Sapiens
uucuauauuuuacauucuuggaaag

SEQ ID NO: 4514 - RNA, 23 nt, Homo Sapiens
uuugugcacucugcucuaaaaca

SEQ ID NO: 4515 - RNA, 22 nt, Homo Sapiens
uuuuccauauagagcacuaugu

SEQ ID NO: 4516 - RNA, 20 nt, Homo Sapiens
uuuuaguauaauggugcuau

SEQ ID NO: 4517 - RNA, 26 nt, Homo Sapiens
uugcaaaaaugguccuggaguuggua

SEQ ID NO: 4518 - RNA, 24 nt, Homo Sapiens
uuugaaaaacacaaugauuccuuc

SEQ ID NO: 4519 - RNA, 21 nt, Homo Sapiens
uuguuucuuuaagaaaguacu

SEQ ID NO: 4520 - RNA, 22 nt, Homo Sapiens
uuuaagcgauucuccugccuca

SEQ ID NO: 4521 - RNA, 25 nt, Homo Sapiens
uuuugugcacucugcucuaaaacag

SEQ ID NO: 4522 - RNA, 22 nt, Homo Sapiens
uuuuuaaucuuaaaagauugug

SEQ ID NO: 4523 - RNA, 19 nt, Homo Sapiens
uugucucacuugugcagug

SEQ ID NO: 4524 - RNA, 21 nt, Homo Sapiens
uugcacacaccuucuucuaca

SEQ ID NO: 4525 - RNA, 19 nt, Homo Sapiens
uugguaaaauacuucuuga

SEQ ID NO: 4526 - RNA, 29 nt, Homo Sapiens
ucuacuuuuaaguugcugaugaacucuua

SEQ ID NO: 4527 - RNA, 23 nt, Homo Sapiens
ucucuccugaagcuccauccccu

SEQ ID NO: 4528 - RNA, 20 nt, Homo Sapiens
ucauuuucaaaauggaggga

SEQ ID NO: 4529 - RNA, 19 nt, Homo Sapiens
uccaugccuuccuuucucc

SEQ ID NO: 4530 - RNA, 24 nt, Homo Sapiens
guucucuucucuacccugcccuaa

SEQ ID NO: 4531 - RNA, 21 nt, Homo Sapiens
ugaauaaaugaaccaaaucaa

SEQ ID NO: 4532 - RNA, 28 nt, Homo Sapiens
gccaaguauucugccaauucacccugga

SEQ ID NO: 4533 - RNA, 25 nt, Homo Sapiens
ggcuucuggcugaggccuuacgcau

SEQ ID NO: 4534 - RNA, 23 nt, Homo Sapiens
cugggaccucaguuuuaucauuu

SEQ ID NO: 4535 - RNA, 20 nt, Homo Sapiens
cuguucucuucucuacccug

SEQ ID NO: 4536 - RNA, 20 nt, Homo Sapiens
cuucccuuuuucuaagacua

SEQ ID NO: 4537 - RNA, 22 nt, Homo Sapiens
cuugcacacaccuucuucuaca

SEQ ID NO: 4538 - RNA, 20 nt, Homo Sapiens
gacuauggcuaccaaaaaga

SEQ ID NO: 4539 - RNA, 17 nt, Homo Sapiens
gacuucuuugugcucaa

SEQ ID NO: 4540 - RNA, 23 nt, Homo Sapiens
cgauuucucccuuccuccuagaa

SEQ ID NO: 4541 - RNA, 23 nt, Homo Sapiens
ccuuucucccaaucuccauuccc

SEQ ID NO: 4542 - RNA, 24 nt, Homo Sapiens
ccuucuucuacagaagacacaccu

SEQ ID NO: 4543 - RNA, 24 nt, Homo Sapiens
aucauuuucaaaauggagggaaua

SEQ ID NO: 4544 - RNA, 23 nt, Homo Sapiens
cagaagaguaagaggaucaagac

SEQ ID NO: 4545 - RNA, 20 nt, Homo Sapiens
caacaccauugaaggcucau

SEQ ID NO: 4546 - RNA, 24 nt, Homo Sapiens
auuugcugagcauguacugagccu

SEQ ID NO: 4547 - RNA, 20 nt, Homo Sapiens
cccuggagcacaaucaacaa

SEQ ID NO: 4548 - RNA, 23 nt, Homo Sapiens
cccguuuugacgacgcacuugua

SEQ ID NO: 4549 - RNA, 21 nt, Homo Sapiens
cccauagccaggaaacucugc

SEQ ID NO: 4550 - RNA, 22 nt, Homo Sapiens
cauuuugguaaaauacuucuug

SEQ ID NO: 4551 - RNA, 22 nt, Homo Sapiens
cauuuugguccaaguugugcuu

SEQ ID NO: 4552 - RNA, 24 nt, Homo Sapiens
ccaaucauuuuaauuauuauucuu

SEQ ID NO: 4553 - RNA, 22 nt, Homo Sapiens
acagaugggcaaauuaaggcau

SEQ ID NO: 4554 - RNA, 19 nt, Homo Sapiens
acuauggcuaccaaaaaga

SEQ ID NO: 4555 - RNA, 26 nt, Homo Sapiens
aggaucaagacuucuuugugcucaaa

SEQ ID NO: 4556 - RNA, 30 nt, Homo Sapiens
agaagaccaggcuucucucugguccuuggu

SEQ ID NO: 4557 - RNA, 22 nt, Homo Sapiens
agaaaacuaagaaauaugcaca

SEQ ID NO: 4558 - RNA, 21 nt, Homo Sapiens
aauacaaaacugaauucuucc

SEQ ID NO: 4559 - RNA, 23 nt, Homo Sapiens
aagagccuaguuuuuaauagcua

SEQ ID NO: 4560 - RNA, 21 nt, Homo Sapiens
aagcucagauuauuuaaaugg

SEQ ID NO: 4561 - RNA, 27 nt, Homo Sapiens
agagcuguacccagagaguccugugcu

SEQ ID NO: 4562 - RNA, 24 nt, Homo Sapiens
aauuuggacuggugugcucucuuu

SEQ ID NO: 4563 - RNA, 27 nt, Homo Sapiens
ccaaugcccaacugccugccuuagggu

SEQ ID NO: 4564 - RNA, 21 nt, Homo Sapiens
aguccugugcugaauguggac

SEQ ID NO: 4565 - RNA, 22 nt, Homo Sapiens
ccuguugucuacaccaaugccc

SEQ ID NO: 4566 - RNA, 22 nt, Homo Sapiens
ccucucucaccucuccuacuca

SEQ ID NO: 4567 - RNA, 25 nt, Homo Sapiens
gcacaaggcacaacaggcugcucug

SEQ ID NO: 4568 - RNA, 24 nt, Homo Sapiens
gcuaagaggaucuccuguccauca

SEQ ID NO: 4569 - RNA, 26 nt, Homo Sapiens
gccugacagaaaccacggccacauuu

SEQ ID NO: 4570 - RNA, 22 nt, Homo Sapiens
gcugcucugggauucucuucag

SEQ ID NO: 4571 - RNA, 21 nt, Homo Sapiens
ugguucuaagaaacccucugu

SEQ ID NO: 4572 - RNA, 22 nt, Homo Sapiens
uugagccaggccucucucaccu

SEQ ID NO: 4573 - RNA, 23 nt, Homo Sapiens
uuuggacuggugugcucucuuua

SEQ ID NO: 4574 - RNA, 22 nt, Homo Sapiens
uuggauuucggggcagggggcg

SEQ ID NO: 4575 - RNA, 19 nt, Homo Sapiens
uuacaacuaaauaacacag

SEQ ID NO: 4576 - RNA, 21 nt, Homo Sapiens
ugggugagguaggcgggaaag

SEQ ID NO: 4577 - RNA, 22 nt, Homo Sapiens
ugccuucagggagacaggcagg

SEQ ID NO: 4578 - RNA, 27 nt, Homo Sapiens
ucaagcccccuccaaaggcuccccuac

SEQ ID NO: 4579 - RNA, 21 nt, Homo Sapiens
uccaggcccaugcacugagga

SEQ ID NO: 4580 - RNA, 24 nt, Homo Sapiens
gcuugcccgcucccacagcuuccu

SEQ ID NO: 4581 - RNA, 21 nt, Homo Sapiens
ggagagaaguagcaggaccag

SEQ ID NO: 4582 - RNA, 27 nt, Homo Sapiens
gcggaaacaaggggagcccccagagcu

SEQ ID NO: 4583 - RNA, 19 nt, Homo Sapiens
gggaagggagaguucuuug

SEQ ID NO: 4584 - RNA, 22 nt, Homo Sapiens
gggagacaggcagggagggcuu

SEQ ID NO: 4585 - RNA, 20 nt, Homo Sapiens
gggugagguaggcgggaaag

SEQ ID NO: 4586 - RNA, 23 nt, Homo Sapiens
gugagguaggcgggaaaggaugg

SEQ ID NO: 4587 - RNA, 21 nt, Homo Sapiens
gugggccacacccaggaaggg

SEQ ID NO: 4588 - RNA, 21 nt, Homo Sapiens
gacaggcccucccugucucca

SEQ ID NO: 4589 - RNA, 28 nt, Homo Sapiens
cuuugccaaggcucuccccucucgcccc

SEQ ID NO: 4590 - RNA, 22 nt, Homo Sapiens
ccggggagggggaaagagcagc

SEQ ID NO: 4591 - RNA, 26 nt, Homo Sapiens
ccugucuggaagacguggcucugggu

SEQ ID NO: 4592 - RNA, 23 nt, Homo Sapiens
ccuucccuggccccgccggaugu

SEQ ID NO: 4593 - RNA, 27 nt, Homo Sapiens
cuccagccuccccuccccuggggacgc

SEQ ID NO: 4594 - RNA, 21 nt, Homo Sapiens
cggggagggggaaagagcagc

SEQ ID NO: 4595 - RNA, 23 nt, Homo Sapiens
auaauuuuugcugaauucuuuac

SEQ ID NO: 4596 - RNA, 23 nt, Homo Sapiens
ccacugggagagcugguggugca

SEQ ID NO: 4597 - RNA, 27 nt, Homo Sapiens
caggaagggaaagcgggcagccccguu

SEQ ID NO: 4598 - RNA, 27 nt, Homo Sapiens
ccccaacuccaggggcaccuaugagau

SEQ ID NO: 4599 - RNA, 21 nt, Homo Sapiens
cccagccccaacuccaggggc

SEQ ID NO: 4600 - RNA, 27 nt, Homo Sapiens
cccagccccaacuccaggggcaccuau

SEQ ID NO: 4601 - RNA, 22 nt, Homo Sapiens
ccauccccucccugccugcucc

SEQ ID NO: 4602 - RNA, 16 nt, Homo Sapiens
agcaggaccagagggg

SEQ ID NO: 4603 - RNA, 21 nt, Homo Sapiens
aagccuccugcccccugccgg

SEQ ID NO: 4604 - RNA, 23 nt, Homo Sapiens
aagcuguuuaguuuguuaauuga

SEQ ID NO: 4605 - RNA, 20 nt, Homo Sapiens
agacccuugaagauguagcu

SEQ ID NO: 4606 - RNA, 25 nt, Homo Sapiens
agcucucuaaauugacucagcucca

SEQ ID NO: 4607 - RNA, 25 nt, Homo Sapiens
agcauuuucuuuaccaguauccuua

SEQ ID NO: 4608 - RNA, 22 nt, Homo Sapiens
agccugcuucuuccccaggguu

SEQ ID NO: 4609 - RNA, 18 nt, Homo Sapiens
aauguauauuuaacuucu

SEQ ID NO: 4610 - RNA, 18 nt, Homo Sapiens
accauaaaaacuuacuua

SEQ ID NO: 4611 - RNA, 23 nt, Homo Sapiens
accccuguauuucacgcagcucu

SEQ ID NO: 4612 - RNA, 21 nt, Homo Sapiens
accggcaaccuguaacugccc

SEQ ID NO: 4613 - RNA, 22 nt, Homo Sapiens
cauccagcaugugugugucucu

SEQ ID NO: 4614 - RNA, 25 nt, Homo Sapiens
caggcccaucucagaucuucacuau

SEQ ID NO: 4615 - RNA, 27 nt, Homo Sapiens
ccaacagcaggcccaucucagaucuuc

SEQ ID NO: 4616 - RNA, 22 nt, Homo Sapiens
aggagaugaugugauggaacac

SEQ ID NO: 4617 - RNA, 24 nt, Homo Sapiens
cucagaucuucacuauggcaacuu

SEQ ID NO: 4618 - RNA, 23 nt, Homo Sapiens
ccuuucagaaccaaacacaugcc

SEQ ID NO: 4619 - RNA, 27 nt, Homo Sapiens
ccuccaacucuucuucauccuccuagc

SEQ ID NO: 4620 - RNA, 27 nt, Homo Sapiens
cuugacagaaauguggccauuaagaag

SEQ ID NO: 4621 - RNA, 27 nt, Homo Sapiens
cugcccuuuuaaauggcaugacaaggu

SEQ ID NO: 4622 - RNA, 20 nt, Homo Sapiens
gaaaucaccuguccaucguu

SEQ ID NO: 4623 - RNA, 22 nt, Homo Sapiens
gagaaauggcguggcaggggac

SEQ ID NO: 4624 - RNA, 32 nt, Homo Sapiens
gagaaauggcguggcaggggacccagcgagcc

SEQ ID NO: 4625 - RNA, 21 nt, Homo Sapiens
gauuaaacuguaugucuuaua

SEQ ID NO: 4626 - RNA, 25 nt, Homo Sapiens
gaucaggaucguaguucucaggcac

SEQ ID NO: 4627 - RNA, 27 nt, Homo Sapiens
ggugcagcagugacagcagugagaguc

SEQ ID NO: 4628 - RNA, 19 nt, Homo Sapiens
gguggugcuugcuauaugc

SEQ ID NO: 4629 - RNA, 27 nt, Homo Sapiens
gguggugcuugcuauaugcuuaccuuu

SEQ ID NO: 4630 - RNA, 23 nt, Homo Sapiens
ggcacggaauggcuagugugaga

SEQ ID NO: 4631 - RNA, 25 nt, Homo Sapiens
gccgcugcuuccucuaccccuguau

SEQ ID NO: 4632 - RNA, 21 nt, Homo Sapiens
ggagaugaugugauggaacac

SEQ ID NO: 4633 - RNA, 27 nt, Homo Sapiens
uccucaccccucaauuccuaggggcuu

SEQ ID NO: 4634 - RNA, 27 nt, Homo Sapiens
ucacuuuuuauuuuuaugggggugggu

SEQ ID NO: 4635 - RNA, 25 nt, Homo Sapiens
guggaugugucauauauugccaaac

SEQ ID NO: 4636 - RNA, 21 nt, Homo Sapiens
ucuuuaccaguauccuuaauc

SEQ ID NO: 4637 - RNA, 29 nt, Homo Sapiens
ucuugcaucuaccugcuccuuggccuagu

SEQ ID NO: 4638 - RNA, 19 nt, Homo Sapiens
ugucauauauugccaaaca

SEQ ID NO: 4639 - RNA, 25 nt, Homo Sapiens
uggaucucuacagugccgcguauga

SEQ ID NO: 4640 - RNA, 20 nt, Homo Sapiens
uggccauuaagaagcucagc

SEQ ID NO: 4641 - RNA, 27 nt, Homo Sapiens
uuuuacaaauuuccuuuuuuguccuca

SEQ ID NO: 4642 - RNA, 26 nt, Homo Sapiens
uuugaaccaggauggcugagccccgc

SEQ ID NO: 4643 - RNA, 23 nt, Homo Sapiens
uuucccaggcagcuggcuaguuc

SEQ ID NO: 4644 - RNA, 21 nt, Homo Sapiens
uucggcugcauuucuucacgc

SEQ ID NO: 4645 - RNA, 23 nt, Homo Sapiens
uucgguucccugucuccuccucc

SEQ ID NO: 4646 - RNA, 24 nt, Homo Sapiens
uucaugauuucaaccacauuugcu

SEQ ID NO: 4647 - RNA, 27 nt, Homo Sapiens
uucaugauuucaaccacauuugcuaga

SEQ ID NO: 4648 - RNA, 21 nt, Homo Sapiens
uuccucccucccugcagggua

SEQ ID NO: 4649 - RNA, 27 nt, Homo Sapiens
ugggaccccagccucucacucucaguu

SEQ ID NO: 4650 - RNA, 23 nt, Homo Sapiens
uggaggggcagcgcagccuccca

SEQ ID NO: 4651 - RNA, 21 nt, Homo Sapiens
uggcauccuucccucuaagcc

SEQ ID NO: 4652 - RNA, 25 nt, Homo Sapiens
uggacaucugguugcuuuggccugc

SEQ ID NO: 4653 - RNA, 21 nt, Homo Sapiens
ugguggcaccaggauggaagg

SEQ ID NO: 4654 - RNA, 25 nt, Homo Sapiens
ucuuggggccagccuaagaucaugg

SEQ ID NO: 4655 - RNA, 25 nt, Homo Sapiens
ucuugugcccugcucuucagcacca

SEQ ID NO: 4656 - RNA, 22 nt, Homo Sapiens
ucugguugcuuuggccugcugc

SEQ ID NO: 4657 - RNA, 21 nt, Homo Sapiens
ugccgccgccaccacagccac

SEQ ID NO: 4658 - RNA, 19 nt, Homo Sapiens
ugccaugagaaaagggaag

SEQ ID NO: 4659 - RNA, 27 nt, Homo Sapiens
ugcccccagcugcuccucgcaguucgg

SEQ ID NO: 4660 - RNA, 17 nt, Homo Sapiens
uagagggagggagcagc

SEQ ID NO: 4661 - RNA, 28 nt, Homo Sapiens
uccuccucccgucacagaugugagccag

SEQ ID NO: 4662 - RNA, 20 nt, Homo Sapiens
uccccccagggcugggcacu

SEQ ID NO: 4663 - RNA, 21 nt, Homo Sapiens
ucagugaugggaguaagagca

SEQ ID NO: 4664 - RNA, 25 nt, Homo Sapiens
ggacaugaaaucaucuuagcuuagc

SEQ ID NO: 4665 - RNA, 24 nt, Homo Sapiens
gcgagggcagaggugaucaccugc

SEQ ID NO: 4666 - RNA, 21 nt, Homo Sapiens
gcagaggggaggaggaagcac

SEQ ID NO: 4667 - RNA, 23 nt, Homo Sapiens
gcagaggggaggaggaagcacaa

SEQ ID NO: 4668 - RNA, 21 nt, Homo Sapiens
ggcaggggcugggcagagggg

SEQ ID NO: 4669 - RNA, 25 nt, Homo Sapiens
ggcccuugggguuucucuuuuccac

SEQ ID NO: 4670 - RNA, 26 nt, Homo Sapiens
ggccgaggcaggggcugggcagaggg

SEQ ID NO: 4671 - RNA, 24 nt, Homo Sapiens
gggacuucaaaaucagugauggga

SEQ ID NO: 4672 - RNA, 21 nt, Homo Sapiens
guggugagacuguauccuguu

SEQ ID NO: 4673 - RNA, 27 nt, Homo Sapiens
gugagugugacggggguuggggugggg

SEQ ID NO: 4674 - RNA, 23 nt, Homo Sapiens
guccuaagcccacaaucaugccu

SEQ ID NO: 4675 - RNA, 23 nt, Homo Sapiens
gucaggagacacuguucccaaag

SEQ ID NO: 4676 - RNA, 26 nt, Homo Sapiens
gagugugugggggucugggaggcagg

SEQ ID NO: 4677 - RNA, 27 nt, Homo Sapiens
gagcccaaucacugccuauaccccuca

SEQ ID NO: 4678 - RNA, 26 nt, Homo Sapiens
gaggaugguucucucuggucauagcc

SEQ ID NO: 4679 - RNA, 22 nt, Homo Sapiens
gcaauuccuuuugauucuuuuu

SEQ ID NO: 4680 - RNA, 21 nt, Homo Sapiens
gacucacuuuaucaauaguuc

SEQ ID NO: 4681 - RNA, 21 nt, Homo Sapiens
gaccccagccucucacucuca

SEQ ID NO: 4682 - RNA, 20 nt, Homo Sapiens
gaagagggagaaggagaggc

SEQ ID NO: 4683 - RNA, 27 nt, Homo Sapiens
cugggccacuggcaucucuggagugug

SEQ ID NO: 4684 - RNA, 28 nt, Homo Sapiens
cugggacucguguggccuguguggugcc

SEQ ID NO: 4685 - RNA, 19 nt, Homo Sapiens
cuuucugucugugaauguc

SEQ ID NO: 4686 - RNA, 20 nt, Homo Sapiens
ccucugugccaccucucaca

SEQ ID NO: 4687 - RNA, 26 nt, Homo Sapiens
ccuuggggcucccugugucagggcac

SEQ ID NO: 4688 - RNA, 19 nt, Homo Sapiens
cuaagcccacaaucaugcc

SEQ ID NO: 4689 - RNA, 25 nt, Homo Sapiens
cucugggaucucccccuuguggggc

SEQ ID NO: 4690 - RNA, 21 nt, Homo Sapiens
agggcgccugagccuaggcgg

SEQ ID NO: 4691 - RNA, 21 nt, Homo Sapiens
aggccuggccccuuccugugc

SEQ ID NO: 4692 - RNA, 21 nt, Homo Sapiens
agggugaucagugcuggcaga

SEQ ID NO: 4693 - RNA, 27 nt, Homo Sapiens
auccuguuugcuauugcuuguugugcu

SEQ ID NO: 4694 - RNA, 26 nt, Homo Sapiens
cacuuaaccugcuuuugucacucggc

SEQ ID NO: 4695 - RNA, 24 nt, Homo Sapiens
cacugggacucguguggccugugu

SEQ ID NO: 4696 - RNA, 25 nt, Homo Sapiens
cacagacuaggucuuguggcugguc

SEQ ID NO: 4697 - RNA, 22 nt, Homo Sapiens
cacagccaccuucuccuccucc

SEQ ID NO: 4698 - RNA, 21 nt, Homo Sapiens
ccaacagcagcgccgcugcca

SEQ ID NO: 4699 - RNA, 22 nt, Homo Sapiens
ccacagaaacccuguuuuauug

SEQ ID NO: 4700 - RNA, 22 nt, Homo Sapiens
caggcugggugucuugguuguc

SEQ ID NO: 4701 - RNA, 18 nt, Homo Sapiens
caggcagcuggcuaguuc

SEQ ID NO: 4702 - RNA, 27 nt, Homo Sapiens
ccccagccaggugcaggcguaggaaua

SEQ ID NO: 4703 - RNA, 20 nt, Homo Sapiens
cccuacuuccccuuggggcu

SEQ ID NO: 4704 - RNA, 25 nt, Homo Sapiens
ccccugagaaggccuggccccuucc

SEQ ID NO: 4705 - RNA, 26 nt, Homo Sapiens
ccccgucugcgccgcugugcuguugu

SEQ ID NO: 4706 - RNA, 24 nt, Homo Sapiens
cccugcucuucagcaccaugggcc

SEQ ID NO: 4707 - RNA, 19 nt, Homo Sapiens
accuacuccauacugaggg

SEQ ID NO: 4708 - RNA, 27 nt, Homo Sapiens
accaggauggcugagccccgccaggag

SEQ ID NO: 4709 - RNA, 22 nt, Homo Sapiens
aggcaggggcugggcagagggg

SEQ ID NO: 4710 - RNA, 24 nt, Homo Sapiens
agaaggagaaggaaauguggggua

SEQ ID NO: 4711 - RNA, 23 nt, Homo Sapiens
agcagcaggcugggugucuuggu

SEQ ID NO: 4712 - RNA, 22 nt, Homo Sapiens
aacuucugauuucucuucagcu

SEQ ID NO: 4713 - RNA, 19 nt, Homo Sapiens
aagagggagaaggagaggc

SEQ ID NO: 4714 - RNA, 19 nt, Homo Sapiens
aacuccaucugcugccaug

SEQ ID NO: 4715 - RNA, 20 nt, Homo Sapiens
aacuccaucugcugccauga

SEQ ID NO: 4716 - RNA, 21 nt, Homo Sapiens
aacccuguuuuauugaguucu

SEQ ID NO: 4717 - RNA, 20 nt, Homo Sapiens
aaacuucugauuucucuuca

SEQ ID NO: 4718 - RNA, 21 nt, Homo Sapiens
aaaacuucugauuucucuuca

SEQ ID NO: 4719 - RNA, 23 nt, Homo Sapiens
aaacucauuuuugccauacauca

SEQ ID NO: 4720 - RNA, 26 nt, Homo Sapiens
aaaacaaugcaaaaccuuugagguag

SEQ ID NO: 4721 - RNA, 22 nt, Homo Sapiens
aaauuauaguuucaagccaacu

SEQ ID NO: 4722 - RNA, 23 nt, Homo Sapiens
aaguggggcaaaaccuugcuaau

SEQ ID NO: 4723 - RNA, 23 nt, Homo Sapiens
acuuauuuuauuuccaucauguc

SEQ ID NO: 4724 - RNA, 22 nt, Homo Sapiens
agcucugcaucuccugucuuuu

SEQ ID NO: 4725 - RNA, 27 nt, Homo Sapiens
agcucugcaucuccugucuuuucaggu

SEQ ID NO: 4726 - RNA, 21 nt, Homo Sapiens
aaugcugccuucccaugaauc

SEQ ID NO: 4727 - RNA, 20 nt, Homo Sapiens
acuauccugacuucuaauau

SEQ ID NO: 4728 - RNA, 22 nt, Homo Sapiens
acucuucacuguuagcuuuuua

SEQ ID NO: 4729 - RNA, 23 nt, Homo Sapiens
acugaacaauggcccuguagcca

SEQ ID NO: 4730 - RNA, 21 nt, Homo Sapiens
cagcucuaauaaaacagcugu

SEQ ID NO: 4731 - RNA, 26 nt, Homo Sapiens
ccagaagaagaguaggugacacuaua

SEQ ID NO: 4732 - RNA, 20 nt, Homo Sapiens
cauucuuguugccacagcug

SEQ ID NO: 4733 - RNA, 21 nt, Homo Sapiens
cauugccuaacuacuaguuuu

SEQ ID NO: 4734 - RNA, 22 nt, Homo Sapiens
auuuccauaguucccugcggcc

SEQ ID NO: 4735 - RNA, 23 nt, Homo Sapiens
auuguggaucuuuucauucucau

SEQ ID NO: 4736 - RNA, 23 nt, Homo Sapiens
augggcccuaggggucacuguac

SEQ ID NO: 4737 - RNA, 22 nt, Homo Sapiens
auacuauaacauauguacauaa

SEQ ID NO: 4738 - RNA, 27 nt, Homo Sapiens
auacuauaacauauguacauaaauugc

SEQ ID NO: 4739 - RNA, 26 nt, Homo Sapiens
aguauguguccaaugcugccuuccca

SEQ ID NO: 4740 - RNA, 27 nt, Homo Sapiens
aggcgcuuggcugggcucucagcccgc

SEQ ID NO: 4741 - RNA, 20 nt, Homo Sapiens
cuccugacagggugaccuug

SEQ ID NO: 4742 - RNA, 22 nt, Homo Sapiens
ccuuugagguagaccaggauuu

SEQ ID NO: 4743 - RNA, 25 nt, Homo Sapiens
ccuuacccuuuccuccuuuaucaca

SEQ ID NO: 4744 - RNA, 19 nt, Homo Sapiens
ccugagagugucucugaua

SEQ ID NO: 4745 - RNA, 22 nt, Homo Sapiens
ccucacacauccagacaucaug

SEQ ID NO: 4746 - RNA, 19 nt, Homo Sapiens
cuuuaggguaaaaauugcg

SEQ ID NO: 4747 - RNA, 21 nt, Homo Sapiens
cuuguugccacagcuggagcu

SEQ ID NO: 4748 - RNA, 21 nt, Homo Sapiens
cuuacuugagccuuuaaugga

SEQ ID NO: 4749 - RNA, 21 nt, Homo Sapiens
cuuauuucuucaaauccuucc

SEQ ID NO: 4750 - RNA, 22 nt, Homo Sapiens
cuuauuuuauuuccaucauguc

SEQ ID NO: 4751 - RNA, 21 nt, Homo Sapiens
cuggcuucuuucucucagccu

SEQ ID NO: 4752 - RNA, 25 nt, Homo Sapiens
cugucucccaguuaugaaucagugg

SEQ ID NO: 4753 - RNA, 27 nt, Homo Sapiens
cugucucuugaaaaaugcccauuugcc

SEQ ID NO: 4754 - RNA, 20 nt, Homo Sapiens
cugcauguuaccaucuuacu

SEQ ID NO: 4755 - RNA, 22 nt, Homo Sapiens
gaacaacaacuauccugacuuc

SEQ ID NO: 4756 - RNA, 22 nt, Homo Sapiens
gaauuugccauucugcuguaca

SEQ ID NO: 4757 - RNA, 20 nt, Homo Sapiens
gacugugacaacugucuaac

SEQ ID NO: 4758 - RNA, 20 nt, Homo Sapiens
gaugaaagcagggaauuucu

SEQ ID NO: 4759 - RNA, 21 nt, Homo Sapiens
gaguucuggucaaagaaagaa

SEQ ID NO: 4760 - RNA, 28 nt, Homo Sapiens
gauacccuuacccuuuccuccuuuauca

SEQ ID NO: 4761 - RNA, 25 nt, Homo Sapiens
gucacuuuauuacucccagaacaac

SEQ ID NO: 4762 - RNA, 27 nt, Homo Sapiens
gucggcucagcagccuccaacuucucc

SEQ ID NO: 4763 - RNA, 28 nt, Homo Sapiens
gugaaccaagaucuauaaagcgauauac

SEQ ID NO: 4764 - RNA, 24 nt, Homo Sapiens
gugagacaaaauuuuaguccaaau

SEQ ID NO: 4765 - RNA, 21 nt, Homo Sapiens
gguagaccaggauuucuaauc

SEQ ID NO: 4766 - RNA, 26 nt, Homo Sapiens
ggcuuccugcaauuuucuaagcaauu

SEQ ID NO: 4767 - RNA, 20 nt, Homo Sapiens
ggggaguuauguuuuguuac

SEQ ID NO: 4768 - RNA, 19 nt, Homo Sapiens
gcagccgcccaacuccugg

SEQ ID NO: 4769 - RNA, 28 nt, Homo Sapiens
gccacuagacucuucacuguuagcuuuu

SEQ ID NO: 4770 - RNA, 17 nt, Homo Sapiens
gcucuaaaagcaccucc

SEQ ID NO: 4771 - RNA, 23 nt, Homo Sapiens
ggaauuugccauucugcuguaca

SEQ ID NO: 4772 - RNA, 21 nt, Homo Sapiens
ggaacaacucuccagugccug

SEQ ID NO: 4773 - RNA, 20 nt, Homo Sapiens
ucaguuauucauucugugau

SEQ ID NO: 4774 - RNA, 22 nt, Homo Sapiens
uccauuuuggcgcuauuacaaa

SEQ ID NO: 4775 - RNA, 26 nt, Homo Sapiens
uccugacagggugaccuuggguauuu

SEQ ID NO: 4776 - RNA, 24 nt, Homo Sapiens
uccuuuaucacaaccaccguuaca

SEQ ID NO: 4777 - RNA, 21 nt, Homo Sapiens
ucucucagccuuacauuugug

SEQ ID NO: 4778 - RNA, 22 nt, Homo Sapiens
uagaaaacaaugcaaaaccuuu

SEQ ID NO: 4779 - RNA, 23 nt, Homo Sapiens
ucaaguuugggucugugcugcug

SEQ ID NO: 4780 - RNA, 19 nt, Homo Sapiens
guuauucauucugugauca

SEQ ID NO: 4781 - RNA, 27 nt, Homo Sapiens
uaaaugaugaguauuaguucccugucu

SEQ ID NO: 4782 - RNA, 23 nt, Homo Sapiens
ugcggccucugccuuggggaguu

SEQ ID NO: 4783 - RNA, 20 nt, Homo Sapiens
ugcaccuauguagcucugca

SEQ ID NO: 4784 - RNA, 22 nt, Homo Sapiens
ugaaucugucucccaguuauga

SEQ ID NO: 4785 - RNA, 24 nt, Homo Sapiens
ugucuucaaaagaagcauugcagc

SEQ ID NO: 4786 - RNA, 21 nt, Homo Sapiens
uucauucugugaucauuuauu

SEQ ID NO: 4787 - RNA, 27 nt, Homo Sapiens
uucauucugugaucauuuauuuuaagc

SEQ ID NO: 4788 - RNA, 25 nt, Homo Sapiens
uugaccgagagcaggcuggagcagc

SEQ ID NO: 4789 - RNA, 25 nt, Homo Sapiens
uucuuguugccacagcuggagcucu

SEQ ID NO: 4790 - RNA, 20 nt, Homo Sapiens
uucuuucucucagccuuaca

SEQ ID NO: 4791 - RNA, 29 nt, Homo Sapiens
uugccauucugcuguacagacacugauuu

SEQ ID NO: 4792 - RNA, 24 nt, Homo Sapiens
uuguaccugcuuugacugaugcug

SEQ ID NO: 4793 - RNA, 23 nt, Homo Sapiens
uuuaagugucugaaucgagugag

SEQ ID NO: 4794 - RNA, 23 nt, Homo Sapiens
uugggccucugcuucucucaccu

SEQ ID NO: 4795 - RNA, 18 nt, Homo Sapiens
uuuuauuuccaucauguc

SEQ ID NO: 4796 - RNA, 20 nt, Homo Sapiens
uuuauccauagacagggccc

SEQ ID NO: 4797 - RNA, 22 nt, Homo Sapiens
uauugagcaccuacuacaugca

SEQ ID NO: 4798 - RNA, 23 nt, Homo Sapiens
uccuugcccuagaugagcccagc

SEQ ID NO: 4799 - RNA, 22 nt, Homo Sapiens
uccucacccugauuucuugcuu

SEQ ID NO: 4800 - RNA, 25 nt, Homo Sapiens
ucaggugagcuguggaggugggguc

SEQ ID NO: 4801 - RNA, 22 nt, Homo Sapiens
ggagaagagagauggggguucc

SEQ ID NO: 4802 - RNA, 22 nt, Homo Sapiens
ggagcacagcucaggaacuaga

SEQ ID NO: 4803 - RNA, 21 nt, Homo Sapiens
ggaggugggguccuuggaagc

SEQ ID NO: 4804 - RNA, 20 nt, Homo Sapiens
gcuccccuuuuucuuccuca

SEQ ID NO: 4805 - RNA, 21 nt, Homo Sapiens
gcucaggaacuagacugccug

SEQ ID NO: 4806 - RNA, 21 nt, Homo Sapiens
gcugggcugugugguugacuu

SEQ ID NO: 4807 - RNA, 23 nt, Homo Sapiens
gcccagcccuguucugggugcag

SEQ ID NO: 4808 - RNA, 24 nt, Homo Sapiens
gggccuguugcccuuucuguacca

SEQ ID NO: 4809 - RNA, 21 nt, Homo Sapiens
gggaagccuccuaaggccagg

SEQ ID NO: 4810 - RNA, 27 nt, Homo Sapiens
ggccagguaagggggugcagcagugag

SEQ ID NO: 4811 - RNA, 25 nt, Homo Sapiens
ggcuccccuuuuucuuccucacccu

SEQ ID NO: 4812 - RNA, 20 nt, Homo Sapiens
ggugagcuguggaggugggg

SEQ ID NO: 4813 - RNA, 27 nt, Homo Sapiens
gagcaaauuacccuccuuaaacaagag

SEQ ID NO: 4814 - RNA, 26 nt, Homo Sapiens
cuuguaaauuacaucugucaugguuu

SEQ ID NO: 4815 - RNA, 16 nt, Homo Sapiens
ccucaaggaggucugg

SEQ ID NO: 4816 - RNA, 23 nt, Homo Sapiens
ccucugguucuucauuuauugag

SEQ ID NO: 4817 - RNA, 21 nt, Homo Sapiens
cugaguauguggaaggcagca

SEQ ID NO: 4818 - RNA, 28 nt, Homo Sapiens
cugaguauguggaaggcagcagagcgga

SEQ ID NO: 4819 - RNA, 21 nt, Homo Sapiens
agggcccacuuguauccucug

SEQ ID NO: 4820 - RNA, 23 nt, Homo Sapiens
aucuguguccugguuagcagagc

SEQ ID NO: 4821 - RNA, 22 nt, Homo Sapiens
cagcucaggaacuagacugccu

SEQ ID NO: 4822 - RNA, 17 nt, Homo Sapiens
cccucaaggaggucugg

SEQ ID NO: 4823 - RNA, 23 nt, Homo Sapiens
acagcucaggaacuagacugccu

SEQ ID NO: 4824 - RNA, 22 nt, Homo Sapiens
aggcagcagagcggacugguga

SEQ ID NO: 4825 - RNA, 23 nt, Homo Sapiens
aaggcagcagagcggacugguga

SEQ ID NO: 4826 - RNA, 21 nt, Homo Sapiens
ccagcugcugcucuccucgac

SEQ ID NO: 4827 - RNA, 25 nt, Homo Sapiens
cguucaccgccuccagcugcugcuc

SEQ ID NO: 4828 - RNA, 23 nt, Homo Sapiens
ccugguguucccuuucccugcug

SEQ ID NO: 4829 - RNA, 24 nt, Homo Sapiens
ccugguguucccuuucccugcuga

SEQ ID NO: 4830 - RNA, 22 nt, Homo Sapiens
gcugcucuccucgacauggacc

SEQ ID NO: 4831 - RNA, 22 nt, Homo Sapiens
gcuggggugagaguaagcugcu

SEQ ID NO: 4832 - RNA, 22 nt, Homo Sapiens
gcucacaccuguaaucucagca

SEQ ID NO: 4833 - RNA, 22 nt, Homo Sapiens
ggaggcugaggugggcagauca

SEQ ID NO: 4834 - RNA, 23 nt, Homo Sapiens
gccuguaaucccagcuacucagg

SEQ ID NO: 4835 - RNA, 26 nt, Homo Sapiens
gccuguaaucccagcuacucaggaga

SEQ ID NO: 4836 - RNA, 21 nt, Homo Sapiens
ggggugagaguaagcugcuga

SEQ ID NO: 4837 - RNA, 23 nt, Homo Sapiens
ccuggcugcugccauaguuucug

SEQ ID NO: 4838 - RNA, 22 nt, Homo Sapiens
ccuguaaucccagcuacucagg

SEQ ID NO: 4839 - RNA, 21 nt, Homo Sapiens
ccuguaaucucagcacuuugg

SEQ ID NO: 4840 - RNA, 21 nt, Homo Sapiens
cgcucacaccuguaaucucag

SEQ ID NO: 4841 - RNA, 25 nt, Homo Sapiens
cucgcucuugacagaugucugggaa

SEQ ID NO: 4842 - RNA, 27 nt, Homo Sapiens
cuugacagaugucugggaaagcagagu

SEQ ID NO: 4843 - RNA, 25 nt, Homo Sapiens
gaaagagaauuuuauuuauaaauga

SEQ ID NO: 4844 - RNA, 20 nt, Homo Sapiens
cuggcugcugccauaguuuc

SEQ ID NO: 4845 - RNA, 22 nt, Homo Sapiens
gagccccagaggcagagguugu

SEQ ID NO: 4846 - RNA, 22 nt, Homo Sapiens
gcacacgccuguaaucccagcu

SEQ ID NO: 4847 - RNA, 20 nt, Homo Sapiens
ccgagaucgcgccaguacau

SEQ ID NO: 4848 - RNA, 21 nt, Homo Sapiens
cagaggcagagguugugguga

SEQ ID NO: 4849 - RNA, 16 nt, Homo Sapiens
cauaggccgggcacag

SEQ ID NO: 4850 - RNA, 21 nt, Homo Sapiens
ccagaggcagagguuguggug

SEQ ID NO: 4851 - RNA, 22 nt, Homo Sapiens
ccagaggcagagguugugguga

SEQ ID NO: 4852 - RNA, 26 nt, Homo Sapiens
ccacaaccaacaccacaaaccuuuca

SEQ ID NO: 4853 - RNA, 23 nt, Homo Sapiens
aggcugaggugggcagaucaacu

SEQ ID NO: 4854 - RNA, 22 nt, Homo Sapiens
aguaagcugcugaaugcauuca

SEQ ID NO: 4855 - RNA, 21 nt, Homo Sapiens
caccuguaaucucagcacuuu

SEQ ID NO: 4856 - RNA, 22 nt, Homo Sapiens
caccuguaaucucagcacuuug

SEQ ID NO: 4857 - RNA, 22 nt, Homo Sapiens
cacaccuguaaucucagcacuu

SEQ ID NO: 4858 - RNA, 23 nt, Homo Sapiens
cacgccuguaaucccagcuacuc

SEQ ID NO: 4859 - RNA, 27 nt, Homo Sapiens
accacaaccaacaccacaaaccuuuca

SEQ ID NO: 4860 - RNA, 23 nt, Homo Sapiens
aaugcgguucagggcugggguga

SEQ ID NO: 4861 - RNA, 25 nt, Homo Sapiens
acaaaagggguaauugcauucuucu

SEQ ID NO: 4862 - RNA, 22 nt, Homo Sapiens
acaccuguaaucucagcacuuu

SEQ ID NO: 4863 - RNA, 21 nt, Homo Sapiens
accuguaaucucagcacuuug

SEQ ID NO: 4864 - RNA, 22 nt, Homo Sapiens
accuguaaucucagcacuuugg

SEQ ID NO: 4865 - RNA, 31 nt, Homo Sapiens
ucaguuaauggcucaucaacaaucacaacca

SEQ ID NO: 4866 - RNA, 23 nt, Homo Sapiens
ucccuugagccccagaggcagag

SEQ ID NO: 4867 - RNA, 22 nt, Homo Sapiens
ucagcuggcagaguuagcauug

SEQ ID NO: 4868 - RNA, 26 nt, Homo Sapiens
ucagcacuuugggaggcugagguggg

SEQ ID NO: 4869 - RNA, 27 nt, Homo Sapiens
ucagcacuuugggaggcugaggugggc

SEQ ID NO: 4870 - RNA, 19 nt, Homo Sapiens
uaaaugagugccacaaaag

SEQ ID NO: 4871 - RNA, 24 nt, Homo Sapiens
uggugcacacgccuguaaucccag

SEQ ID NO: 4872 - RNA, 27 nt, Homo Sapiens
uuaauggcucaucaacaaucacaacca

SEQ ID NO: 4873 - RNA, 22 nt, Homo Sapiens
uguggugagccgagaucgcgcc

SEQ ID NO: 4874 - RNA, 30 nt, Homo Sapiens
uuagaagcagaucauuucccaaaauucuaa

SEQ ID NO: 4875 - RNA, 26 nt, Homo Sapiens
uucuaagagcagcagcauauguuguu

SEQ ID NO: 4876 - RNA, 30 nt, Homo Sapiens
ugcacauucacugaauucacugagauuauu

SEQ ID NO: 4877 - RNA, 22 nt, Homo Sapiens
uaaggcggaggucgcgggcggg

SEQ ID NO: 4878 - RNA, 22 nt, Homo Sapiens
uagggaagaguucugaucugua

SEQ ID NO: 4879 - RNA, 26 nt, Homo Sapiens
accaugucgcgcucagugcugcagcc

SEQ ID NO: 4880 - RNA, 27 nt, Homo Sapiens
aaauacuguaacacuguauaacauuua

SEQ ID NO: 4881 - RNA, 26 nt, Homo Sapiens
caacauuggaugugcauuucugugau

SEQ ID NO: 4882 - RNA, 26 nt, Homo Sapiens
caugucgcgcucagugcugcagccca

SEQ ID NO: 4883 - RNA, 18 nt, Homo Sapiens
ccagcaccaccaugucgc

SEQ ID NO: 4884 - RNA, 23 nt, Homo Sapiens
cccaaaauucuaagagcagcagc

SEQ ID NO: 4885 - RNA, 27 nt, Homo Sapiens
cggaaggcaggaggcugccggggcgcg

SEQ ID NO: 4886 - RNA, 21 nt, Homo Sapiens
gguuguauuuucugaucauug

SEQ ID NO: 4887 - RNA, 18 nt, Homo Sapiens
gugcauuucugugauguu

SEQ ID NO: 4888 - RNA, 17 nt, Homo Sapiens
gcgggaggggaggaggc

SEQ ID NO: 4889 - RNA, 23 nt, Homo Sapiens
ggaaggcaggaggcugccggggc

SEQ ID NO: 4890 - RNA, 21 nt, Homo Sapiens
gccagauuuugggauuacaaa

SEQ ID NO: 4891 - RNA, 24 nt, Homo Sapiens
cuggaaccucccugggccugucuc

SEQ ID NO: 4892 - RNA, 23 nt, Homo Sapiens
cccaccccuguacccagccaccu

SEQ ID NO: 4893 - RNA, 23 nt, Homo Sapiens
ccccugaggacaggggcaucucu

SEQ ID NO: 4894 - RNA, 20 nt, Homo Sapiens
ccagauuuugggauuacaaa

SEQ ID NO: 4895 - RNA, 22 nt, Homo Sapiens
auugccucccuuccuccgcucc

SEQ ID NO: 4896 - RNA, 22 nt, Homo Sapiens
cacgaacuuccggucucuuagg

SEQ ID NO: 4897 - RNA, 25 nt, Homo Sapiens
cacuggaaccucccugggccugucu

SEQ ID NO: 4898 - RNA, 30 nt, Homo Sapiens
cacuggaaccucccugggccugucucagau

SEQ ID NO: 4899 - RNA, 17 nt, Homo Sapiens
cacuuccuagagcaucu

SEQ ID NO: 4900 - RNA, 24 nt, Homo Sapiens
cacaaccacuaauuugucacugga

SEQ ID NO: 4901 - RNA, 16 nt, Homo Sapiens
agcuucuugcuccugu

SEQ ID NO: 4902 - RNA, 23 nt, Homo Sapiens
uggguaucccaccuccagcccac

SEQ ID NO: 4903 - RNA, 23 nt, Homo Sapiens
uuaacucccuaguuacccacccu

SEQ ID NO: 4904 - RNA, 18 nt, Homo Sapiens
uuucuugccagcucagca

SEQ ID NO: 4905 - RNA, 26 nt, Homo Sapiens
uugccucccuuccuccgcuccccuuu

SEQ ID NO: 4906 - RNA, 19 nt, Homo Sapiens
uugcucugugcugacugug

SEQ ID NO: 4907 - RNA, 20 nt, Homo Sapiens
uuugcucugugcugacugug

SEQ ID NO: 4908 - RNA, 22 nt, Homo Sapiens
uuugcucugugcugacuguggu

SEQ ID NO: 4909 - RNA, 25 nt, Homo Sapiens
ugugugccaguacucaggcagcugg

SEQ ID NO: 4910 - RNA, 20 nt, Homo Sapiens
ugguggcagaggugggauga

SEQ ID NO: 4911 - RNA, 23 nt, Homo Sapiens
ugucugucuguuggccuguaucu

SEQ ID NO: 4912 - RNA, 28 nt, Homo Sapiens
ugcuucuucaggugagugcaggccaagg

SEQ ID NO: 4913 - RNA, 25 nt, Homo Sapiens
uggagagaagagaaggcagcagcag

SEQ ID NO: 4914 - RNA, 20 nt, Homo Sapiens
ucugucuguccugcuucuuc

SEQ ID NO: 4915 - RNA, 21 nt, Homo Sapiens
ucugcugggaacucccugacu

SEQ ID NO: 4916 - RNA, 26 nt, Homo Sapiens
uagccucuuucuugcguuucuuuuua

SEQ ID NO: 4917 - RNA, 24 nt, Homo Sapiens
aggaacccagcuagcuggccaggu

SEQ ID NO: 4918 - RNA, 27 nt, Homo Sapiens
aggagagagucuuaccuccccuggccc

SEQ ID NO: 4919 - RNA, 21 nt, Homo Sapiens
aaugggucucauuugagucuc

SEQ ID NO: 4920 - RNA, 16 nt, Homo Sapiens
auggggcagggcuggg

SEQ ID NO: 4921 - RNA, 22 nt, Homo Sapiens
ccagccaucugcacuuguacca

SEQ ID NO: 4922 - RNA, 25 nt, Homo Sapiens
ccaagcuucccugcaucuugguccu

SEQ ID NO: 4923 - RNA, 28 nt, Homo Sapiens
ccaagcuucccugcaucuugguccuugu

SEQ ID NO: 4924 - RNA, 27 nt, Homo Sapiens
caggcagcuggagagaagagaaggcag

SEQ ID NO: 4925 - RNA, 26 nt, Homo Sapiens
ccccauccaucugugucugucuguug

SEQ ID NO: 4926 - RNA, 27 nt, Homo Sapiens
cccucauucagcacuucugcugggaac

SEQ ID NO: 4927 - RNA, 23 nt, Homo Sapiens
ccauccaucugugucugucuguu

SEQ ID NO: 4928 - RNA, 23 nt, Homo Sapiens
ccagguggggaggggcuggggac

SEQ ID NO: 4929 - RNA, 22 nt, Homo Sapiens
cuggccgcgcgccuuuucucuc

SEQ ID NO: 4930 - RNA, 29 nt, Homo Sapiens
cuggagggggcgggggccguggcggcuuu

SEQ ID NO: 4931 - RNA, 23 nt, Homo Sapiens
cuucugcugggaacucccugacu

SEQ ID NO: 4932 - RNA, 27 nt, Homo Sapiens
cuuaccuccccuggcccuccuuucugg

SEQ ID NO: 4933 - RNA, 19 nt, Homo Sapiens
gaggggugacuucauccca

SEQ ID NO: 4934 - RNA, 22 nt, Homo Sapiens
gagagaagagaaggcagcagca

SEQ ID NO: 4935 - RNA, 21 nt, Homo Sapiens
cgcaggagagagucuuaccuc

SEQ ID NO: 4936 - RNA, 23 nt, Homo Sapiens
ccuccccuggcccuccuuucugg

SEQ ID NO: 4937 - RNA, 28 nt, Homo Sapiens
ccuccccuggcccuccuuucuggcucag

SEQ ID NO: 4938 - RNA, 23 nt, Homo Sapiens
gcuagcuggccagguggggaggg

SEQ ID NO: 4939 - RNA, 21 nt, Homo Sapiens
gccuucuguccugccugccca

SEQ ID NO: 4940 - RNA, 21 nt, Homo Sapiens
ggaggugggagaggauggggc

SEQ ID NO: 4941 - RNA, 24 nt, Homo Sapiens
ggagagaagagaaggcagcagcag

SEQ ID NO: 4942 - RNA, 23 nt, Homo Sapiens
gcugcaggaacccagcuagcugg

SEQ ID NO: 4943 - RNA, 30 nt, Homo Sapiens
gcugcaggaacccagcuagcuggccaggug

SEQ ID NO: 4944 - RNA, 23 nt, Homo Sapiens
guggggaggggcuggggaccggc

SEQ ID NO: 4945 - RNA, 19 nt, Homo Sapiens
gguggcagaggugggauga

SEQ ID NO: 4946 - RNA, 27 nt, Homo Sapiens
ggugauggggcagggcugggucucagu

SEQ ID NO: 4947 - RNA, 25 nt, Homo Sapiens
ggcggccccagcaccucagccugca

SEQ ID NO: 4948 - RNA, 23 nt, Homo Sapiens
gggaggcgggggcugcccuuggg

SEQ ID NO: 4949 - RNA, 21 nt, Homo Sapiens
gccugcacagugucccccagg

SEQ ID NO: 4950 - RNA, 27 nt, Homo Sapiens
gccccagguagaaacuuuuaucuauuc

SEQ ID NO: 4951 - RNA, 19 nt, Homo Sapiens
ccugcacuccucagggcag

SEQ ID NO: 4952 - RNA, 26 nt, Homo Sapiens
cgcagcccuggcagggggcaugcggu

SEQ ID NO: 4953 - RNA, 22 nt, Homo Sapiens
cggcccccugcccguucuugaa

SEQ ID NO: 4954 - RNA, 25 nt, Homo Sapiens
cgggcaggggcuggagggaggcggg

SEQ ID NO: 4955 - RNA, 27 nt, Homo Sapiens
gagacuugccagagccgggcacauuga

SEQ ID NO: 4956 - RNA, 21 nt, Homo Sapiens
cccagcaccucagccugcaca

SEQ ID NO: 4957 - RNA, 27 nt, Homo Sapiens
cccagcaccucagccugcacagugucc

SEQ ID NO: 4958 - RNA, 23 nt, Homo Sapiens
agggcagccucccccggcucuac

SEQ ID NO: 4959 - RNA, 30 nt, Homo Sapiens
auagaguguaguuuacagaaaaagacuuua

SEQ ID NO: 4960 - RNA, 22 nt, Homo Sapiens
aguuuacagaaaaagacuuuaa

SEQ ID NO: 4961 - RNA, 20 nt, Homo Sapiens
accucagccugcacaguguc

SEQ ID NO: 4962 - RNA, 27 nt, Homo Sapiens
acuguggcacuugccugggucacacac

SEQ ID NO: 4963 - RNA, 22 nt, Homo Sapiens
agaaaacaagcaaguucugaga

SEQ ID NO: 4964 - RNA, 26 nt, Homo Sapiens
aacugauuugcaauaaaaaugauacu

SEQ ID NO: 4965 - RNA, 27 nt, Homo Sapiens
aacugauuugcaauaaaaaugauacug

SEQ ID NO: 4966 - RNA, 20 nt, Homo Sapiens
aagcaaguucugagagccag

SEQ ID NO: 4967 - RNA, 19 nt, Homo Sapiens
uccagcaacacagccuggg

SEQ ID NO: 4968 - RNA, 22 nt, Homo Sapiens
ucugagaaaacaagcaaguucu

SEQ ID NO: 4969 - RNA, 23 nt, Homo Sapiens
ucuugaaauguaggcaucaugca

SEQ ID NO: 4970 - RNA, 21 nt, Homo Sapiens
guuuaaauaaaguaucaugca

SEQ ID NO: 4971 - RNA, 19 nt, Homo Sapiens
uugcucucuggccuuuucc

SEQ ID NO: 4972 - RNA, 21 nt, Homo Sapiens
acugugcugaauucugcaaug

SEQ ID NO: 4973 - RNA, 27 nt, Homo Sapiens
ccccucggagacgcucgcccgacagca

SEQ ID NO: 4974 - RNA, 24 nt, Homo Sapiens
gaaaugagacuugcucucuggccu

SEQ ID NO: 4975 - RNA, 28 nt, Homo Sapiens
gggaaaugagacuugcucucuggccuuu

SEQ ID NO: 4976 - RNA, 23 nt, Homo Sapiens
gugcugaauucugcaauguuuuc

SEQ ID NO: 4977 - RNA, 21 nt, Homo Sapiens
gguugcuugggccacugcccu

SEQ ID NO: 4978 - RNA, 22 nt, Homo Sapiens
gggcagcuucagucucugcagu

SEQ ID NO: 4979 - RNA, 22 nt, Homo Sapiens
gccccacccacccuccugggcc

SEQ ID NO: 4980 - RNA, 23 nt, Homo Sapiens
gccccuugcuucucaacuaaaga

SEQ ID NO: 4981 - RNA, 22 nt, Homo Sapiens
gcagcaccuggagcccacagag

SEQ ID NO: 4982 - RNA, 27 nt, Homo Sapiens
gcugucgucccccuccagugcuuggcu

SEQ ID NO: 4983 - RNA, 23 nt, Homo Sapiens
gcuggcagagguuucuagggugg

SEQ ID NO: 4984 - RNA, 20 nt, Homo Sapiens
ggagcaggaggaggaaaggu

SEQ ID NO: 4985 - RNA, 26 nt, Homo Sapiens
gagcaguuuuccaggaggccgggggg

SEQ ID NO: 4986 - RNA, 28 nt, Homo Sapiens
cuguuaacccuccaccuccucucuugga

SEQ ID NO: 4987 - RNA, 22 nt, Homo Sapiens
cguuuucuuugcugugccaaag

SEQ ID NO: 4988 - RNA, 20 nt, Homo Sapiens
cucccuccccaccccaacca

SEQ ID NO: 4989 - RNA, 22 nt, Homo Sapiens
ccuuggggaggggucagcucug

SEQ ID NO: 4990 - RNA, 22 nt, Homo Sapiens
ccuguuaacccuccaccuccuc

SEQ ID NO: 4991 - RNA, 25 nt, Homo Sapiens
ccuccccaccagucucacccacuag

SEQ ID NO: 4992 - RNA, 20 nt, Homo Sapiens
ccguccuccucgcugugcca

SEQ ID NO: 4993 - RNA, 20 nt, Homo Sapiens
ccccucccucugcucucaua

SEQ ID NO: 4994 - RNA, 22 nt, Homo Sapiens
cccucauuuaucacucugaccu

SEQ ID NO: 4995 - RNA, 27 nt, Homo Sapiens
cccucauuuaucacucugaccuucaca

SEQ ID NO: 4996 - RNA, 26 nt, Homo Sapiens
cccuccaccuccucucuuggacuccc

SEQ ID NO: 4997 - RNA, 20 nt, Homo Sapiens
cccacccuccugggcccagg

SEQ ID NO: 4998 - RNA, 27 nt, Homo Sapiens
ccauggcuggcagagguuucuagggug

SEQ ID NO: 4999 - RNA, 21 nt, Homo Sapiens
cccacaccaccguccuccucg

SEQ ID NO: 5000 - RNA, 22 nt, Homo Sapiens
cccacagagucuguguguagcc

SEQ ID NO: 5001 - RNA, 27 nt, Homo Sapiens
ccaggaggccggggggagcaggaggag

SEQ ID NO: 5002 - RNA, 25 nt, Homo Sapiens
caggcuguguguggggcccaagcau

SEQ ID NO: 5003 - RNA, 26 nt, Homo Sapiens
auggcuggcagagguuucuagggugg

SEQ ID NO: 5004 - RNA, 24 nt, Homo Sapiens
agaucugauuuauuuauuuugguu

SEQ ID NO: 5005 - RNA, 23 nt, Homo Sapiens
uucaucuugagccugagccuuag

SEQ ID NO: 5006 - RNA, 20 nt, Homo Sapiens
ucguuuucuuugcugugcca

SEQ ID NO: 5007 - RNA, 22 nt, Homo Sapiens
ugacugccccuugcuucucaac

SEQ ID NO: 5008 - RNA, 25 nt, Homo Sapiens
uggcuggcagagguuucuagggugg

SEQ ID NO: 5009 - RNA, 21 nt, Homo Sapiens
uggggaggggucagcucuggc

SEQ ID NO: 5010 - RNA, 26 nt, Homo Sapiens
ugggacaaguggggagcccaagaaag

SEQ ID NO: 5011 - RNA, 26 nt, Homo Sapiens
ugggauguguggcccagagguaagaa

SEQ ID NO: 5012 - RNA, 21 nt, Homo Sapiens
ugcuuuuguuaaaagcuuuau

SEQ ID NO: 5013 - RNA, 22 nt, Homo Sapiens
ugcuucacucucucauucuuag

SEQ ID NO: 5014 - RNA, 26 nt, Homo Sapiens
ucuggcuucuuucacuuugcauaauu

SEQ ID NO: 5015 - RNA, 22 nt, Homo Sapiens
ugcacacaaucuagcaggaauc

SEQ ID NO: 5016 - RNA, 22 nt, Homo Sapiens
uccaucaucccucaaaguguca

SEQ ID NO: 5017 - RNA, 21 nt, Homo Sapiens
uccacccacucuucacaggcu

SEQ ID NO: 5018 - RNA, 21 nt, Homo Sapiens
guucuuguuagaaucauggga

SEQ ID NO: 5019 - RNA, 29 nt, Homo Sapiens
uaccacuuccugaaucaguuauuauuucu

SEQ ID NO: 5020 - RNA, 22 nt, Homo Sapiens
uugcuuuuguuaaaagcuuuau

SEQ ID NO: 5021 - RNA, 22 nt, Homo Sapiens
uuuaguuuugggauauuacaaa

SEQ ID NO: 5022 - RNA, 22 nt, Homo Sapiens
agaacauggagaacuugcucaa

SEQ ID NO: 5023 - RNA, 23 nt, Homo Sapiens
agaacuccuuugcagaaacuggg

SEQ ID NO: 5024 - RNA, 21 nt, Homo Sapiens
aacugugguccaucuccagac

SEQ ID NO: 5025 - RNA, 22 nt, Homo Sapiens
aacaaacuaagccagguaugca

SEQ ID NO: 5026 - RNA, 20 nt, Homo Sapiens
cacuuccugaaucaguuauu

SEQ ID NO: 5027 - RNA, 20 nt, Homo Sapiens
ccaucaucccucaaaguguc

SEQ ID NO: 5028 - RNA, 25 nt, Homo Sapiens
cgaaaucaagaaacucauguucuua

SEQ ID NO: 5029 - RNA, 22 nt, Homo Sapiens
cuguaagcuaauccacaaccug

SEQ ID NO: 5030 - RNA, 23 nt, Homo Sapiens
gcuucacucucucauucuuagcu

SEQ ID NO: 5031 - RNA, 25 nt, Homo Sapiens
ggcucuggaagaaaaggaaaaaguc

SEQ ID NO: 5032 - RNA, 22 nt, Homo Sapiens
gguccaucuccagacucuacca

SEQ ID NO: 5033 - RNA, 24 nt, Homo Sapiens
gucuggcuucuuucacuuugcaua

SEQ ID NO: 5034 - RNA, 24 nt, Homo Sapiens
gucugggaaaaagugcacgugaag

SEQ ID NO: 5035 - RNA, 19 nt, Homo Sapiens
gucccaagcuucccugcca

SEQ ID NO: 5036 - RNA, 21 nt, Homo Sapiens
gggggcccuuccagauugggg

SEQ ID NO: 5037 - RNA, 26 nt, Homo Sapiens
gaggcucccagacccagggcagugug

SEQ ID NO: 5038 - RNA, 27 nt, Homo Sapiens
gagggaagauggcggacgaggagaagc

SEQ ID NO: 5039 - RNA, 24 nt, Homo Sapiens
cacacaguauuuauuguucccaca

SEQ ID NO: 5040 - RNA, 22 nt, Homo Sapiens
ucacccccaauuaaacccagaa

SEQ ID NO: 5041 - RNA, 22 nt, Homo Sapiens
ucauccaauccucacugggugg

SEQ ID NO: 5042 - RNA, 25 nt, Homo Sapiens
ugcaugggcucgaagggagagccag

SEQ ID NO: 5043 - RNA, 19 nt, Homo Sapiens
ucuggacugaagccugcag

SEQ ID NO: 5044 - RNA, 25 nt, Homo Sapiens
ugguugagaaaugaauaauuuccca

SEQ ID NO: 5045 - RNA, 25 nt, Homo Sapiens
uguguguguauguuugcacacuugu

SEQ ID NO: 5046 - RNA, 20 nt, Homo Sapiens
ugugcaugggcucgaaggga

SEQ ID NO: 5047 - RNA, 21 nt, Homo Sapiens
agguuauaggucacuccuggg

SEQ ID NO: 5048 - RNA, 20 nt, Homo Sapiens
agugaucaauaaaaugugau

SEQ ID NO: 5049 - RNA, 23 nt, Homo Sapiens
aaagggcagggcaucuccugugc

SEQ ID NO: 5050 - RNA, 21 nt, Homo Sapiens
aagugaucaauaaaaugugau

SEQ ID NO: 5051 - RNA, 19 nt, Homo Sapiens
agaugucccuuucuuggcc

SEQ ID NO: 5052 - RNA, 19 nt, Homo Sapiens
agagacacuaacgacuuca

SEQ ID NO: 5053 - RNA, 26 nt, Homo Sapiens
acuggguggggugaggaccacuccuu

SEQ ID NO: 5054 - RNA, 27 nt, Homo Sapiens
acuggguggggugaggaccacuccuua

SEQ ID NO: 5055 - RNA, 20 nt, Homo Sapiens
accugugaccagcacugucu

SEQ ID NO: 5056 - RNA, 22 nt, Homo Sapiens
ccugugaccagcacugucucag

SEQ ID NO: 5057 - RNA, 25 nt, Homo Sapiens
ccucuggccaggauggagggguggu

SEQ ID NO: 5058 - RNA, 20 nt, Homo Sapiens
gucucaguuucacuuucaca

SEQ ID NO: 5059 - RNA, 23 nt, Homo Sapiens
ggagagguuauaggucacuccug

SEQ ID NO: 5060 - RNA, 17 nt, Homo Sapiens
gcccagucccuggagcu

SEQ ID NO: 5061 - RNA, 21 nt, Homo Sapiens
ccugcucccagccucuugcuc

SEQ ID NO: 5062 - RNA, 27 nt, Homo Sapiens
ccugcucccagccucuugcucagagcu

SEQ ID NO: 5063 - RNA, 26 nt, Homo Sapiens
aggacuagcuggaggaacccaguggg

SEQ ID NO: 5064 - RNA, 22 nt, Homo Sapiens
aacauagugucugcugcugccu

SEQ ID NO: 5065 - RNA, 23 nt, Homo Sapiens
ccccugagugggcugggcccucu

SEQ ID NO: 5066 - RNA, 16 nt, Homo Sapiens
ucuccacccuccggcc

SEQ ID NO: 5067 - RNA, 27 nt, Homo Sapiens
uagcccagucccuggagcuguccuuca

SEQ ID NO: 5068 - RNA, 26 nt, Homo Sapiens
uaguuuuucacuuuagcaaaggggca

SEQ ID NO: 5069 - RNA, 20 nt, Homo Sapiens
uauuaucauuucuccuuuaa

SEQ ID NO: 5070 - RNA, 22 nt, Homo Sapiens
gugugagccaccacgcccugcc

SEQ ID NO: 5071 - RNA, 18 nt, Homo Sapiens
gugugugccaucaugccu

SEQ ID NO: 5072 - RNA, 22 nt, Homo Sapiens
guugcccaggcuggagugcaac

SEQ ID NO: 5073 - RNA, 23 nt, Homo Sapiens
guugcccaggcuggagugcaacg

SEQ ID NO: 5074 - RNA, 27 nt, Homo Sapiens
guugcccaggcuggagugcaacggcau

SEQ ID NO: 5075 - RNA, 22 nt, Homo Sapiens
guugcccaggcuggagugcagu

SEQ ID NO: 5076 - RNA, 23 nt, Homo Sapiens
guugcccaggcuggagugcagug

SEQ ID NO: 5077 - RNA, 21 nt, Homo Sapiens
ucuccgucacuccauucucag

SEQ ID NO: 5078 - RNA, 23 nt, Homo Sapiens
ucucauucuguugcccaggcugg

SEQ ID NO: 5079 - RNA, 27 nt, Homo Sapiens
ucuagaucagagagcaagaaaaaagua

SEQ ID NO: 5080 - RNA, 21 nt, Homo Sapiens
uccaguuuuuugccacugcaa

SEQ ID NO: 5081 - RNA, 22 nt, Homo Sapiens
uccgaguagcugggauuacagg

SEQ ID NO: 5082 - RNA, 18 nt, Homo Sapiens
uggaacaacagcuaucua

SEQ ID NO: 5083 - RNA, 20 nt, Homo Sapiens
ucugccucccaggcucaagc

SEQ ID NO: 5084 - RNA, 23 nt, Homo Sapiens
ucuugaacuccugaccucaggug

SEQ ID NO: 5085 - RNA, 28 nt, Homo Sapiens
ucuugaacuccugaccucaggugaucca

SEQ ID NO: 5086 - RNA, 22 nt, Homo Sapiens
ucuguugcccaggcuggagugc

SEQ ID NO: 5087 - RNA, 21 nt, Homo Sapiens
ucuguuuuaaauuuaaaacaa

SEQ ID NO: 5088 - RNA, 21 nt, Homo Sapiens
ucuuagagguagguguauucc

SEQ ID NO: 5089 - RNA, 22 nt, Homo Sapiens
ugaacuccugaccucaggugau

SEQ ID NO: 5090 - RNA, 23 nt, Homo Sapiens
ugcagccucugccucccaggcuc

SEQ ID NO: 5091 - RNA, 24 nt, Homo Sapiens
ugagccaccacgcccugccuacuc

SEQ ID NO: 5092 - RNA, 20 nt, Homo Sapiens
ugcccaggcuggagugcaac

SEQ ID NO: 5093 - RNA, 22 nt, Homo Sapiens
ugcccaggcuggagugcaacgg

SEQ ID NO: 5094 - RNA, 20 nt, Homo Sapiens
ugcccaggcuggagugcagu

SEQ ID NO: 5095 - RNA, 22 nt, Homo Sapiens
ugcccaggcuggagugcagugg

SEQ ID NO: 5096 - RNA, 22 nt, Homo Sapiens
uguugcccaggcuggagugcaa

SEQ ID NO: 5097 - RNA, 23 nt, Homo Sapiens
uguugcccaggcuggagugcaac

SEQ ID NO: 5098 - RNA, 22 nt, Homo Sapiens
uguugcccaggcuggagugcag

SEQ ID NO: 5099 - RNA, 23 nt, Homo Sapiens
uguugcccaggcuggagugcagu

SEQ ID NO: 5100 - RNA, 21 nt, Homo Sapiens
uguuggccaggcuggucucga

SEQ ID NO: 5101 - RNA, 18 nt, Homo Sapiens
uugcccaggcuggagugc

SEQ ID NO: 5102 - RNA, 21 nt, Homo Sapiens
uugcccaggcuggagugcaac

SEQ ID NO: 5103 - RNA, 22 nt, Homo Sapiens
uugcccaggcuggagugcaacg

SEQ ID NO: 5104 - RNA, 27 nt, Homo Sapiens
uugcccaggcuggagugcaacggcaug

SEQ ID NO: 5105 - RNA, 22 nt, Homo Sapiens
uugcccaggcuggagugcagug

SEQ ID NO: 5106 - RNA, 27 nt, Homo Sapiens
uugcccaggcuggagugcaguggcgug

SEQ ID NO: 5107 - RNA, 21 nt, Homo Sapiens
uuuaguuuuucacuuuagcaa

SEQ ID NO: 5108 - RNA, 21 nt, Homo Sapiens
uuguugcccaggcuggagugc

SEQ ID NO: 5109 - RNA, 26 nt, Homo Sapiens
uuggaacaacagcuaucuagauagcu

SEQ ID NO: 5110 - RNA, 19 nt, Homo Sapiens
cccaggcuggagugcagug

SEQ ID NO: 5111 - RNA, 22 nt, Homo Sapiens
cccaaagugcugggauuacagg

SEQ ID NO: 5112 - RNA, 22 nt, Homo Sapiens
cccaaguaggugggauuacagg

SEQ ID NO: 5113 - RNA, 27 nt, Homo Sapiens
ccaggaggcuggcaguacagagugcag

SEQ ID NO: 5114 - RNA, 22 nt, Homo Sapiens
caggcuggagugcaguggcgug

SEQ ID NO: 5115 - RNA, 27 nt, Homo Sapiens
caggcuggagugcaguggcgugaucuu

SEQ ID NO: 5116 - RNA, 20 nt, Homo Sapiens
caggcuggagugcaacggca

SEQ ID NO: 5117 - RNA, 23 nt, Homo Sapiens
cagccuuacacugggcacaugga

SEQ ID NO: 5118 - RNA, 22 nt, Homo Sapiens
ccaaguaggugggauuacaggu

SEQ ID NO: 5119 - RNA, 24 nt, Homo Sapiens
caugauuuuggcucacugcagccu

SEQ ID NO: 5120 - RNA, 22 nt, Homo Sapiens
ccaaagugcugggauuacaggu

SEQ ID NO: 5121 - RNA, 26 nt, Homo Sapiens
agucucucauuucuuucaagacagcc

SEQ ID NO: 5122 - RNA, 23 nt, Homo Sapiens
aggugcccaccaccaagcccugc

SEQ ID NO: 5123 - RNA, 23 nt, Homo Sapiens
aggcuggagugcaacggcaugau

SEQ ID NO: 5124 - RNA, 23 nt, Homo Sapiens
aggcuggagugcaguggcgugau

SEQ ID NO: 5125 - RNA, 24 nt, Homo Sapiens
aggcuccaccuuaacugugcucag

SEQ ID NO: 5126 - RNA, 22 nt, Homo Sapiens
aguggcgugaucuuggcucacu

SEQ ID NO: 5127 - RNA, 18 nt, Homo Sapiens
aguguuugcuguuucccc

SEQ ID NO: 5128 - RNA, 22 nt, Homo Sapiens
cagauacacaagugagggcuuu

SEQ ID NO: 5129 - RNA, 22 nt, Homo Sapiens
cagagcugucuggugaucacuu

SEQ ID NO: 5130 - RNA, 18 nt, Homo Sapiens
auguuggccaggcugguc

SEQ ID NO: 5131 - RNA, 22 nt, Homo Sapiens
augauuuuggcucacugcagcc

SEQ ID NO: 5132 - RNA, 25 nt, Homo Sapiens
auuugcguauguaaacauucauauu

SEQ ID NO: 5133 - RNA, 27 nt, Homo Sapiens
aacagccuuacacugggcacauggagg

SEQ ID NO: 5134 - RNA, 22 nt, Homo Sapiens
aacggcaugauuuuggcucacu

SEQ ID NO: 5135 - RNA, 21 nt, Homo Sapiens
aagaaagagaaaguacucaga

SEQ ID NO: 5136 - RNA, 19 nt, Homo Sapiens
aaagugacaugaaaauuac

SEQ ID NO: 5137 - RNA, 22 nt, Homo Sapiens
aaagugcugggauuacaggugu

SEQ ID NO: 5138 - RNA, 29 nt, Homo Sapiens
aaacccacgcguguucugaaggugcccag

SEQ ID NO: 5139 - RNA, 22 nt, Homo Sapiens
agccuuccgaguagcugggauu

SEQ ID NO: 5140 - RNA, 24 nt, Homo Sapiens
agcuccauguuuagaaauaaauga

SEQ ID NO: 5141 - RNA, 20 nt, Homo Sapiens
agagacaguguuuugccaug

SEQ ID NO: 5142 - RNA, 23 nt, Homo Sapiens
agcaggaguugauacaccaccuu

SEQ ID NO: 5143 - RNA, 22 nt, Homo Sapiens
acuacaaccuccaccuuccagg

SEQ ID NO: 5144 - RNA, 20 nt, Homo Sapiens
acucuuguugcccaggcugg

SEQ ID NO: 5145 - RNA, 21 nt, Homo Sapiens
acucagaggcugacacugaca

SEQ ID NO: 5146 - RNA, 22 nt, Homo Sapiens
ccgaguagcugggauuacaggu

SEQ ID NO: 5147 - RNA, 26 nt, Homo Sapiens
ccucaggugauccacccaccugggcc

SEQ ID NO: 5148 - RNA, 22 nt, Homo Sapiens
cgaacuccugacaucaggugau

SEQ ID NO: 5149 - RNA, 23 nt, Homo Sapiens
cgaguagcugggauuacaggugu

SEQ ID NO: 5150 - RNA, 22 nt, Homo Sapiens
cuccagagagagccaagguucu

SEQ ID NO: 5151 - RNA, 22 nt, Homo Sapiens
cucggccucccaaagugcuggg

SEQ ID NO: 5152 - RNA, 22 nt, Homo Sapiens
cucuuuggaacaacagcuaucu

SEQ ID NO: 5153 - RNA, 26 nt, Homo Sapiens
cucugccucccaggcucaagcacuuu

SEQ ID NO: 5154 - RNA, 22 nt, Homo Sapiens
cucauccucccaaguagguggg

SEQ ID NO: 5155 - RNA, 22 nt, Homo Sapiens
gaguagcugggauuacaggugu

SEQ ID NO: 5156 - RNA, 22 nt, Homo Sapiens
gaacuccugacaucaggugauc

SEQ ID NO: 5157 - RNA, 22 nt, Homo Sapiens
gaacuccugaccucaggugauc

SEQ ID NO: 5158 - RNA, 23 nt, Homo Sapiens
gacaggguuucaccauguuggcc

SEQ ID NO: 5159 - RNA, 21 nt, Homo Sapiens
gacuaauuuuguauuuuuagu

SEQ ID NO: 5160 - RNA, 21 nt, Homo Sapiens
cugccucccaggcucaagcac

SEQ ID NO: 5161 - RNA, 24 nt, Homo Sapiens
cugccucccaggcucaagcacuuu

SEQ ID NO: 5162 - RNA, 24 nt, Homo Sapiens
cuguugcccaggcuggagugcagu

SEQ ID NO: 5163 - RNA, 22 nt, Homo Sapiens
cuucugcuuccacgguccuguu

SEQ ID NO: 5164 - RNA, 25 nt, Homo Sapiens
gcccaggcuggagugcaguggcgug

SEQ ID NO: 5165 - RNA, 22 nt, Homo Sapiens
gcccaggcuggagugcaguggc

SEQ ID NO: 5166 - RNA, 25 nt, Homo Sapiens
gcaugauuuuggcucacugcagccu

SEQ ID NO: 5167 - RNA, 20 nt, Homo Sapiens
gcaggaugugccuguggcau

SEQ ID NO: 5168 - RNA, 24 nt, Homo Sapiens
gccacucucagagacucccaggag

SEQ ID NO: 5169 - RNA, 22 nt, Homo Sapiens
gcccaggcuggagugcaacggc

SEQ ID NO: 5170 - RNA, 24 nt, Homo Sapiens
gcccaggcuggagugcaacggcau

SEQ ID NO: 5171 - RNA, 25 nt, Homo Sapiens
gcccaggcuggagugcaacggcaug

SEQ ID NO: 5172 - RNA, 19 nt, Homo Sapiens
gcccaggcuggagugcagu

SEQ ID NO: 5173 - RNA, 23 nt, Homo Sapiens
ggaguuguugaacuauauuugga

SEQ ID NO: 5174 - RNA, 17 nt, Homo Sapiens
ggaacaacagcuaucua

SEQ ID NO: 5175 - RNA, 24 nt, Homo Sapiens
gcugaguuuaguuuuucacuuuag

SEQ ID NO: 5176 - RNA, 23 nt, Homo Sapiens
gcucaaguugaugaaucaugggg

SEQ ID NO: 5177 - RNA, 22 nt, Homo Sapiens
gcucacugcagccucugccucc

SEQ ID NO: 5178 - RNA, 22 nt, Homo Sapiens
gucuugaacuccugaccucagg

SEQ ID NO: 5179 - RNA, 22 nt, Homo Sapiens
gucucgaacuccugacaucagg

SEQ ID NO: 5180 - RNA, 19 nt, Homo Sapiens
gugcccaggagcggcgaug

SEQ ID NO: 5181 - RNA, 20 nt, Homo Sapiens
gggguggaauaaaggcugag

SEQ ID NO: 5182 - RNA, 22 nt, Homo Sapiens
ggucucgaacuccugacaucag

SEQ ID NO: 5183 - RNA, 22 nt, Homo Sapiens
ggucuugaacuccugaccucag

SEQ ID NO: 5184 - RNA, 18 nt, Homo Sapiens
gguuuucugcucugucca

SEQ ID NO: 5185 - RNA, 23 nt, Homo Sapiens
ggcuccaccuuaacugugcucag

SEQ ID NO: 5186 - RNA, 21 nt, Homo Sapiens
ggcucacugcagccucugccu

SEQ ID NO: 5187 - RNA, 22 nt, Homo Sapiens
ggcucacugcagccucugccuc

SEQ ID NO: 5188 - RNA, 23 nt, Homo Sapiens
ggcucacugcagccucugccucc

SEQ ID NO: 5189 - RNA, 23 nt, Homo Sapiens
ggcccagaaaucauacuguaagg

SEQ ID NO: 5190 - RNA, 22 nt, Homo Sapiens
ggccucccauagugcugggauu

SEQ ID NO: 5191 - RNA, 22 nt, Homo Sapiens
ggccucccaaagugcugggauu

SEQ ID NO: 5192 - RNA, 24 nt, Homo Sapiens
gggacugugcagcucgaggcucca

SEQ ID NO: 5193 - RNA, 19 nt, Homo Sapiens
ggcuucugaauuauucugg

SEQ ID NO: 5194 - RNA, 22 nt, Homo Sapiens
gggauuacaggugcccaccacc

SEQ ID NO: 5195 - RNA, 22 nt, Homo Sapiens
gggauuacaggugugagccacc

SEQ ID NO: 5196 - RNA, 25 nt, Homo Sapiens
gggauuacaggugugugccaucaug

SEQ ID NO: 5197 - RNA, 20 nt, Homo Sapiens
gggcuacacagcagcuguuc

SEQ ID NO: 5198 - RNA, 23 nt, Homo Sapiens
ggcuaaaacaaaucucagaacag

SEQ ID NO: 5199 - RNA, 27 nt, Homo Sapiens
guaauuaaaaaauggucagugugcaaa

SEQ ID NO: 5200 - RNA, 21 nt, Homo Sapiens
gucaccuagcagauauguauu

SEQ ID NO: 5201 - RNA, 27 nt, Homo Sapiens
gucaccuagcagauauguauuacuuuu

SEQ ID NO: 5202 - RNA, 22 nt, Homo Sapiens
cggauaggcuaaucaauacccu

SEQ ID NO: 5203 - RNA, 24 nt, Homo Sapiens
cuccucuccucacgaccgaggcag

SEQ ID NO: 5204 - RNA, 23 nt, Homo Sapiens
agaccugagaugcuggucaagcc

SEQ ID NO: 5205 - RNA, 26 nt, Homo Sapiens
agcccuuuuagugguggugucucacu

SEQ ID NO: 5206 - RNA, 26 nt, Homo Sapiens
agcucuguguguaccgagaacugggg

SEQ ID NO: 5207 - RNA, 26 nt, Homo Sapiens
augugggaaacccuuuugcguggucc

SEQ ID NO: 5208 - RNA, 17 nt, Homo Sapiens
agguuggagaugacaga

SEQ ID NO: 5209 - RNA, 21 nt, Homo Sapiens
aguaugggcuacacagcagcu

SEQ ID NO: 5210 - RNA, 22 nt, Homo Sapiens
caguaugggcuacacagcagcu

SEQ ID NO: 5211 - RNA, 23 nt, Homo Sapiens
uugggaugcaggcucagcccgcu

SEQ ID NO: 5212 - RNA, 21 nt, Homo Sapiens
uugccuggauaccucuggcuc

SEQ ID NO: 5213 - RNA, 22 nt, Homo Sapiens
uuccuguuuucaccaucuuucu

SEQ ID NO: 5214 - RNA, 26 nt, Homo Sapiens
uguuuagagcaguuaacaucugaagu

SEQ ID NO: 5215 - RNA, 23 nt, Homo Sapiens
uaacagcaaauaaccauugguua

SEQ ID NO: 5216 - RNA, 23 nt, Homo Sapiens
uaaagaagaguaaaauggcuguu

SEQ ID NO: 5217 - RNA, 21 nt, Homo Sapiens
ucagaccuucuuccacagcaa

SEQ ID NO: 5218 - RNA, 16 nt, Homo Sapiens
ucauucuucucuccca

SEQ ID NO: 5219 - RNA, 27 nt, Homo Sapiens
ucuagggucuuacucuuuguaugauga

SEQ ID NO: 5220 - RNA, 28 nt, Homo Sapiens
ucuacuuugccacagauuaucuuguaca

SEQ ID NO: 5221 - RNA, 19 nt, Homo Sapiens
uccucauucuucucuccca

SEQ ID NO: 5222 - RNA, 21 nt, Homo Sapiens
ucugaacuggaguggaguagg

SEQ ID NO: 5223 - RNA, 23 nt, Homo Sapiens
ugagggacgaggucaaggagaua

SEQ ID NO: 5224 - RNA, 28 nt, Homo Sapiens
ugguugguaaagccucagcaacagccag

SEQ ID NO: 5225 - RNA, 19 nt, Homo Sapiens
uggugaagacccagaggaa

SEQ ID NO: 5226 - RNA, 23 nt, Homo Sapiens
uggggaauggagaggugggcagg

SEQ ID NO: 5227 - RNA, 26 nt, Homo Sapiens
ugugaggaagagcaggcaccagcagc

SEQ ID NO: 5228 - RNA, 25 nt, Homo Sapiens
ugugucccucggugcagaaacuacc

SEQ ID NO: 5229 - RNA, 23 nt, Homo Sapiens
uuccaagucuuccugaccaccuu

SEQ ID NO: 5230 - RNA, 20 nt, Homo Sapiens
uuugcugcugcuucccucuc

SEQ ID NO: 5231 - RNA, 19 nt, Homo Sapiens
uuucuucuuugacuauaac

SEQ ID NO: 5232 - RNA, 25 nt, Homo Sapiens
caggcagcuccgggguccgcgguuu

SEQ ID NO: 5233 - RNA, 20 nt, Homo Sapiens
cagccaguaaggcagcucug

SEQ ID NO: 5234 - RNA, 22 nt, Homo Sapiens
ccaccuugcacuauuggacuuu

SEQ ID NO: 5235 - RNA, 24 nt, Homo Sapiens
agguacugugaggaagagcaggca

SEQ ID NO: 5236 - RNA, 22 nt, Homo Sapiens
aguggaggcugggaugggugag

SEQ ID NO: 5237 - RNA, 26 nt, Homo Sapiens
aguggaggcugggaugggugagagaa

SEQ ID NO: 5238 - RNA, 27 nt, Homo Sapiens
auccuuuuuaaaugagacuuguuuucc

SEQ ID NO: 5239 - RNA, 21 nt, Homo Sapiens
cagauuaucuuguacagccuu

SEQ ID NO: 5240 - RNA, 20 nt, Homo Sapiens
cagaauggggaauggagagg

SEQ ID NO: 5241 - RNA, 22 nt, Homo Sapiens
cacguugaaaaucaacccaaua

SEQ ID NO: 5242 - RNA, 21 nt, Homo Sapiens
caccuugcacuauuggacuuu

SEQ ID NO: 5243 - RNA, 26 nt, Homo Sapiens
acuugccccagaugccuccucugucc

SEQ ID NO: 5244 - RNA, 23 nt, Homo Sapiens
agagcaggcaccagcagcagaau

SEQ ID NO: 5245 - RNA, 25 nt, Homo Sapiens
acgauuucacugacacugcgaacuc

SEQ ID NO: 5246 - RNA, 25 nt, Homo Sapiens
aacuggaguggaguaggagaaagag

SEQ ID NO: 5247 - RNA, 20 nt, Homo Sapiens
cuccgcgccucacgccccgg

SEQ ID NO: 5248 - RNA, 20 nt, Homo Sapiens
cucuuccaaucuccaucacc

SEQ ID NO: 5249 - RNA, 24 nt, Homo Sapiens
cggaacucuucaucuuaaacuaca

SEQ ID NO: 5250 - RNA, 21 nt, Homo Sapiens
cucagguuccaaauucaguaa

SEQ ID NO: 5251 - RNA, 20 nt, Homo Sapiens
cucaagcacugacacucauu

SEQ ID NO: 5252 - RNA, 27 nt, Homo Sapiens
cuauagaaaacgauuuugaacauacuu

SEQ ID NO: 5253 - RNA, 22 nt, Homo Sapiens
ccugcugucagaccuucuucca

SEQ ID NO: 5254 - RNA, 27 nt, Homo Sapiens
ccugcugucagaccuucuuccacagca

SEQ ID NO: 5255 - RNA, 21 nt, Homo Sapiens
cuucccuuugauuuuuugcug

SEQ ID NO: 5256 - RNA, 25 nt, Homo Sapiens
gagguacugugaggaagagcaggca

SEQ ID NO: 5257 - RNA, 21 nt, Homo Sapiens
gaggaagagcaggcaccagca

SEQ ID NO: 5258 - RNA, 21 nt, Homo Sapiens
gcaacuggugaaacuccgcgc

SEQ ID NO: 5259 - RNA, 29 nt, Homo Sapiens
gucacaggacgauuucacugacacugcga

SEQ ID NO: 5260 - RNA, 18 nt, Homo Sapiens
ggugaagacccagaggaa

SEQ ID NO: 5261 - RNA, 25 nt, Homo Sapiens
gugaggaagagcaggcaccagcagc

SEQ ID NO: 5262 - RNA, 22 nt, Homo Sapiens
gugacucuuguguuugcugcug

SEQ ID NO: 5263 - RNA, 21 nt, Homo Sapiens
guggaggcugggaugggugag

SEQ ID NO: 5264 - RNA, 20 nt, Homo Sapiens
gugauugccauuucuuccca

SEQ ID NO: 5265 - RNA, 23 nt, Homo Sapiens
gucugaacuggaguggaguagga

SEQ ID NO: 5266 - RNA, 22 nt, Homo Sapiens
ggcagggguuccagcuucccuu

SEQ ID NO: 5267 - RNA, 23 nt, Homo Sapiens
ggcaccagcagcagaauggggaa

SEQ ID NO: 5268 - RNA, 27 nt, Homo Sapiens
ggggucugaucuuucuccuuggucggg

SEQ ID NO: 5269 - RNA, 20 nt, Homo Sapiens
gggaaaugcuguuugcucga

SEQ ID NO: 5270 - RNA, 19 nt, Homo Sapiens
gcauugccagcucuuccaa

SEQ ID NO: 5271 - RNA, 25 nt, Homo Sapiens
gcauugccagcucuuccaaucucca

SEQ ID NO: 5272 - RNA, 28 nt, Homo Sapiens
gcagaauggggaauggagaggugggcag

SEQ ID NO: 5273 - RNA, 27 nt, Homo Sapiens
gcacugacacucauuaccgucugugau

SEQ ID NO: 5274 - RNA, 22 nt, Homo Sapiens
gccgucugaacuggaguggagu

SEQ ID NO: 5275 - RNA, 22 nt, Homo Sapiens
gcuaugcucacauucauggccu

SEQ ID NO: 5276 - RNA, 23 nt, Homo Sapiens
gcucuggcuggagaggaaaagcc

SEQ ID NO: 5277 - RNA, 18 nt, Homo Sapiens
gcuuuguccaugaugucc

SEQ ID NO: 5278 - RNA, 28 nt, Homo Sapiens
ggagagugaugugagggagcugugugac

SEQ ID NO: 5279 - RNA, 23 nt, Homo Sapiens
ggagcaggcauuuccagcaguga

SEQ ID NO: 5280 - RNA, 21 nt, Homo Sapiens
gagcuaaagugacuuuuccca

SEQ ID NO: 5281 - RNA, 26 nt, Homo Sapiens
gaagcaagcuauuggagcugaaggaa

SEQ ID NO: 5282 - RNA, 21 nt, Homo Sapiens
cugugugaccauagaaaguga

SEQ ID NO: 5283 - RNA, 27 nt, Homo Sapiens
ccuggcaccugggugcucuggcuggag

SEQ ID NO: 5284 - RNA, 25 nt, Homo Sapiens
cgcuuuggggagcgccucgcuucac

SEQ ID NO: 5285 - RNA, 25 nt, Homo Sapiens
agcauccggcaugagggcugagaug

SEQ ID NO: 5286 - RNA, 22 nt, Homo Sapiens
agaaacugaggccacagagcua

SEQ ID NO: 5287 - RNA, 25 nt, Homo Sapiens
cacaggcugcaagcugcagggaauu

SEQ ID NO: 5288 - RNA, 19 nt, Homo Sapiens
caaguguccgggauucaga

SEQ ID NO: 5289 - RNA, 20 nt, Homo Sapiens
ccaaguguccgggauucaga

SEQ ID NO: 5290 - RNA, 19 nt, Homo Sapiens
uuggugaggaggaggcaga

SEQ ID NO: 5291 - RNA, 24 nt, Homo Sapiens
uucucagacgucaggagagugaug

SEQ ID NO: 5292 - RNA, 23 nt, Homo Sapiens
ugggacuucucagacgucaggag

SEQ ID NO: 5293 - RNA, 21 nt, Homo Sapiens
uccagcagugaggagacagcc

SEQ ID NO: 5294 - RNA, 23 nt, Homo Sapiens
uacugaugaagaaacugaggcca

SEQ ID NO: 5295 - RNA, 21 nt, Homo Sapiens
ucuaggguuuucuuucauuuu

SEQ ID NO: 5296 - RNA, 20 nt, Homo Sapiens
ugucccuucccagcgcugcu

SEQ ID NO: 5297 - RNA, 21 nt, Homo Sapiens
uguauaugaaucaaaacaaac

SEQ ID NO: 5298 - RNA, 20 nt, Homo Sapiens
ugccuaggauguucugggcu

SEQ ID NO: 5299 - RNA, 23 nt, Homo Sapiens
auccuagugcgggaccccgccuc

SEQ ID NO: 5300 - RNA, 24 nt, Homo Sapiens
agggugacagggacacaacauggc

SEQ ID NO: 5301 - RNA, 20 nt, Homo Sapiens
aauuuggggcaggaaauacu

SEQ ID NO: 5302 - RNA, 20 nt, Homo Sapiens
cgagcaggcauuucugugau

SEQ ID NO: 5303 - RNA, 21 nt, Homo Sapiens
cuuuuccguccagugucggca

SEQ ID NO: 5304 - RNA, 23 nt, Homo Sapiens
ggagcgccaucaugucuuaccag

SEQ ID NO: 5305 - RNA, 25 nt, Homo Sapiens
gggccaggccugggugaucugcugc

SEQ ID NO: 5306 - RNA, 19 nt, Homo Sapiens
ggggugagacaaggaagag

SEQ ID NO: 5307 - RNA, 26 nt, Homo Sapiens
ggggugagacaaggaagaggaugucu

SEQ ID NO: 5308 - RNA, 22 nt, Homo Sapiens
guaagcugacuggccccaggga

SEQ ID NO: 5309 - RNA, 20 nt, Homo Sapiens
gcccugcaagggcguggugg

SEQ ID NO: 5310 - RNA, 20 nt, Homo Sapiens
cuguucuuuaaaugcguucc

SEQ ID NO: 5311 - RNA, 23 nt, Homo Sapiens
aauccgagccagcucugggggcu

SEQ ID NO: 5312 - RNA, 26 nt, Homo Sapiens
aggaagaggaugucugagcuggagaa

SEQ ID NO: 5313 - RNA, 20 nt, Homo Sapiens
aaggagaccaggaaggggug

SEQ ID NO: 5314 - RNA, 22 nt, Homo Sapiens
cacuaccgggggcucugagcca

SEQ ID NO: 5315 - RNA, 27 nt, Homo Sapiens
auucuuucugcuauauuaggccugugu

SEQ ID NO: 5316 - RNA, 27 nt, Homo Sapiens
auuugaaaacacugcuguucuuuaaau

SEQ ID NO: 5317 - RNA, 19 nt, Homo Sapiens
cagccguguuguagcuaau

SEQ ID NO: 5318 - RNA, 26 nt, Homo Sapiens
ucuuucugcuauauuaggccugugug

SEQ ID NO: 5319 - RNA, 31 nt, Homo Sapiens
ucuuucugcuauauuaggccuguguguaagc

SEQ ID NO: 5320 - RNA, 20 nt, Homo Sapiens
uguagcuaauuaggaagcuu

SEQ ID NO: 5321 - RNA, 27 nt, Homo Sapiens
uauccagcauuauuugaaaacacugcu

SEQ ID NO: 5322 - RNA, 20 nt, Homo Sapiens
ugaagcucucacacgcacag

SEQ ID NO: 5323 - RNA, 20 nt, Homo Sapiens
cagucuggaggguccuggcc

SEQ ID NO: 5324 - RNA, 22 nt, Homo Sapiens
cauguguggcccugucugcuua

SEQ ID NO: 5325 - RNA, 21 nt, Homo Sapiens
cccauggacucuucagucugg

SEQ ID NO: 5326 - RNA, 21 nt, Homo Sapiens
auguguggcccugucugcuua

SEQ ID NO: 5327 - RNA, 21 nt, Homo Sapiens
aguaggaacuuggaaugcaag

SEQ ID NO: 5328 - RNA, 19 nt, Homo Sapiens
gaagcucucacacgcacag

SEQ ID NO: 5329 - RNA, 23 nt, Homo Sapiens
ccugugcaccguaguggccaugg

SEQ ID NO: 5330 - RNA, 23 nt, Homo Sapiens
cucuucagucuggaggguccugg

SEQ ID NO: 5331 - RNA, 22 nt, Homo Sapiens
gcccauggacucuucagucugg

SEQ ID NO: 5332 - RNA, 21 nt, Homo Sapiens
ggaccuccauuccacucaucu

SEQ ID NO: 5333 - RNA, 20 nt, Homo Sapiens
cuccacccguucugccucag

SEQ ID NO: 5334 - RNA, 21 nt, Homo Sapiens
cuccucucuguccugccucag

SEQ ID NO: 5335 - RNA, 24 nt, Homo Sapiens
cuaaccuuugagaucacucagcuc

SEQ ID NO: 5336 - RNA, 21 nt, Homo Sapiens
ccuuguucccagugcugucaa

SEQ ID NO: 5337 - RNA, 22 nt, Homo Sapiens
ccucucuguccugccucaggcc

SEQ ID NO: 5338 - RNA, 22 nt, Homo Sapiens
ccucuccacccguucugccuca

SEQ ID NO: 5339 - RNA, 16 nt, Homo Sapiens
gcacccacaccccccg

SEQ ID NO: 5340 - RNA, 23 nt, Homo Sapiens
aucuccagggacucucaggcuaa

SEQ ID NO: 5341 - RNA, 26 nt, Homo Sapiens
auugccucucagggguagugaagcug

SEQ ID NO: 5342 - RNA, 22 nt, Homo Sapiens
cccugcuccucucuguccugcc

SEQ ID NO: 5343 - RNA, 20 nt, Homo Sapiens
ccaucuccuuucagaaaaau

SEQ ID NO: 5344 - RNA, 27 nt, Homo Sapiens
aggaacccugcuccucucuguccugcc

SEQ ID NO: 5345 - RNA, 25 nt, Homo Sapiens
ugccucaggccuaagaagcacucuc

SEQ ID NO: 5346 - RNA, 30 nt, Homo Sapiens
ugcuccucucuguccugccucaggccuaag

SEQ ID NO: 5347 - RNA, 17 nt, Homo Sapiens
ucuccacccguucugcc

SEQ ID NO: 5348 - RNA, 27 nt, Homo Sapiens
ucuccagggacucucaggcuaaccuuu

SEQ ID NO: 5349 - RNA, 30 nt, Homo Sapiens
uccuuuaucuccagggacucucaggcuaac

SEQ ID NO: 5350 - RNA, 22 nt, Homo Sapiens
ucagggguagugaagcugcaga

SEQ ID NO: 5351 - RNA, 21 nt, Homo Sapiens
uuacucguccccgccauucca

SEQ ID NO: 5352 - RNA, 21 nt, Homo Sapiens
uucuccacaaccuccuccucc

SEQ ID NO: 5353 - RNA, 20 nt, Homo Sapiens
ucagugucauuuacuaacca

SEQ ID NO: 5354 - RNA, 32 nt, Homo Sapiens
ucagugucauuuacuaaccagcaggauggaga

SEQ ID NO: 5355 - RNA, 22 nt, Homo Sapiens
uagaaccuucuaauccaugugc

SEQ ID NO: 5356 - RNA, 27 nt, Homo Sapiens
uagaaccuucuaauccaugugcugcug

SEQ ID NO: 5357 - RNA, 27 nt, Homo Sapiens
aggccuccagccacuuauuuccaugga

SEQ ID NO: 5358 - RNA, 29 nt, Homo Sapiens
agacucaaggccuccagccacuuauuucc

SEQ ID NO: 5359 - RNA, 23 nt, Homo Sapiens
acccuaucaucaguuaggauuag

SEQ ID NO: 5360 - RNA, 23 nt, Homo Sapiens
aagcacccagagaucaauuggga

SEQ ID NO: 5361 - RNA, 22 nt, Homo Sapiens
cccuaucaucaguuaggauuag

SEQ ID NO: 5362 - RNA, 24 nt, Homo Sapiens
caguucugaugaggcacgccugcc

SEQ ID NO: 5363 - RNA, 23 nt, Homo Sapiens
auuuuggacgugugaggaugugg

SEQ ID NO: 5364 - RNA, 24 nt, Homo Sapiens
caaccuccuccuccaguucugaug

SEQ ID NO: 5365 - RNA, 20 nt, Homo Sapiens
aucaagucugugaaagucuc

SEQ ID NO: 5366 - RNA, 25 nt, Homo Sapiens
auauucccaugguagacugugacac

SEQ ID NO: 5367 - RNA, 26 nt, Homo Sapiens
ggagagaacagggaugcuaucucgcu

SEQ ID NO: 5368 - RNA, 19 nt, Homo Sapiens
gccuccagccacuuauuuc

SEQ ID NO: 5369 - RNA, 24 nt, Homo Sapiens
ggcacgccugccuucuccccucca

SEQ ID NO: 5370 - RNA, 24 nt, Homo Sapiens
gcccccacucagcauuucggugcu

SEQ ID NO: 5371 - RNA, 28 nt, Homo Sapiens
gccuuuuauuaacauauauuguuauuuu

SEQ ID NO: 5372 - RNA, 22 nt, Homo Sapiens
gccauuugaagaaggaggaauu

SEQ ID NO: 5373 - RNA, 21 nt, Homo Sapiens
gcuguuguucagaaguuguua

SEQ ID NO: 5374 - RNA, 20 nt, Homo Sapiens
cuguuguucagaaguuguua

SEQ ID NO: 5375 - RNA, 20 nt, Homo Sapiens
cuucccuuucacugaaguga

SEQ ID NO: 5376 - RNA, 27 nt, Homo Sapiens
cgaaccugaagccuagaaauaucuuug

SEQ ID NO: 5377 - RNA, 20 nt, Homo Sapiens
aguaucuguaccugccccca

SEQ ID NO: 5378 - RNA, 20 nt, Homo Sapiens
augcuguaccuuucugacaa

SEQ ID NO: 5379 - RNA, 22 nt, Homo Sapiens
accugaagccuagaaauaucuu

SEQ ID NO: 5380 - RNA, 22 nt, Homo Sapiens
ucagcauuucggugcuucccuu

SEQ ID NO: 5381 - RNA, 23 nt, Homo Sapiens
ucggaauucccugaagcaacacu

SEQ ID NO: 5382 - RNA, 27 nt, Homo Sapiens
ugcuguuguucagaaguuguuagugau

SEQ ID NO: 5383 - RNA, 18 nt, Homo Sapiens
ugcccccacucagcauuu

SEQ ID NO: 5384 - RNA, 22 nt, Homo Sapiens
uuccuuaaguggcugugauuaa

SEQ ID NO: 5385 - RNA, 24 nt, Homo Sapiens
uuaagaacugacacaaaggacaaa

SEQ ID NO: 5386 - RNA, 21 nt, Homo Sapiens
uuuaauugagccuuuuauuaa

SEQ ID NO: 5387 - RNA, 22 nt, Homo Sapiens
uuuucucucacugaugcccuuu

SEQ ID NO: 5388 - RNA, 26 nt, Homo Sapiens
uggaaagagaaccaugaaaacaaugc

SEQ ID NO: 5389 - RNA, 26 nt, Homo Sapiens
uacagcauaaagcacauugcugagcc

SEQ ID NO: 5390 - RNA, 24 nt, Homo Sapiens
uuuuucugucauuucuacuuuuug

SEQ ID NO: 5391 - RNA, 25 nt, Homo Sapiens
acagcauaaagcacauugcugagcc

SEQ ID NO: 5392 - RNA, 26 nt, Homo Sapiens
agaguguuuuuucugucauuucuacu

SEQ ID NO: 5393 - RNA, 19 nt, Homo Sapiens
aggaaagaauaaggcagca

SEQ ID NO: 5394 - RNA, 17 nt, Homo Sapiens
aauaucaggaugccuua

SEQ ID NO: 5395 - RNA, 19 nt, Homo Sapiens
cauugcugagccagaguca

SEQ ID NO: 5396 - RNA, 19 nt, Homo Sapiens
cagcacaauucugucccug

SEQ ID NO: 5397 - RNA, 23 nt, Homo Sapiens
cgcagccgccgcuccauccccag

SEQ ID NO: 5398 - RNA, 22 nt, Homo Sapiens
ccggggcauggacagggccagg

SEQ ID NO: 5399 - RNA, 22 nt, Homo Sapiens
gcaacccccucggagccugugu

SEQ ID NO: 5400 - RNA, 28 nt, Homo Sapiens
uccuguuccacuccggccuuccuagcgg

SEQ ID NO: 5401 - RNA, 26 nt, Homo Sapiens
ugagccagaggcguagggcccaggag

SEQ ID NO: 5402 - RNA, 26 nt, Homo Sapiens
ucuuccuuccgcucugaggcaacccc

SEQ ID NO: 5403 - RNA, 19 nt, Homo Sapiens
ucugucccugucccugccc

SEQ ID NO: 5404 - RNA, 25 nt, Homo Sapiens
ugcgagcuccguccugccugcagca

SEQ ID NO: 5405 - RNA, 25 nt, Homo Sapiens
gagacuaagggcuacaggccagcgu

SEQ ID NO: 5406 - RNA, 31 nt, Homo Sapiens
cugcgagcuccguccugccugcagcagcaca

SEQ ID NO: 5407 - RNA, 21 nt, Homo Sapiens
cugcugcaccaaccucacugc

SEQ ID NO: 5408 - RNA, 26 nt, Homo Sapiens
ccugcgagcuccguccugccugcagc

SEQ ID NO: 5409 - RNA, 22 nt, Homo Sapiens
ccugugcugcugcaccaaccuc

SEQ ID NO: 5410 - RNA, 27 nt, Homo Sapiens
cugaguauguuaagcucuuuaugacug

SEQ ID NO: 5411 - RNA, 19 nt, Homo Sapiens
uuguagcauuucuugaugu

SEQ ID NO: 5412 - RNA, 22 nt, Homo Sapiens
ugaugggaauugugugauguuu

SEQ ID NO: 5413 - RNA, 23 nt, Homo Sapiens
ucugcagcuguuuuaguuaaauu

SEQ ID NO: 5414 - RNA, 19 nt, Homo Sapiens
ugcuagucgggcuuggggg

SEQ ID NO: 5415 - RNA, 23 nt, Homo Sapiens
ugggaauugugugauguuuaaca

SEQ ID NO: 5416 - RNA, 27 nt, Homo Sapiens
uggaggaguccaggccauggaggcaga

SEQ ID NO: 5417 - RNA, 19 nt, Homo Sapiens
uggaggcagaauccuggcc

SEQ ID NO: 5418 - RNA, 26 nt, Homo Sapiens
uaguugagcaaagggguccucacguu

SEQ ID NO: 5419 - RNA, 21 nt, Homo Sapiens
cugagagcugggcagggggga

SEQ ID NO: 5420 - RNA, 21 nt, Homo Sapiens
cuggggcagccaagaacgagc

SEQ ID NO: 5421 - RNA, 27 nt, Homo Sapiens
cugggagggagggguccuccagcagaa

SEQ ID NO: 5422 - RNA, 21 nt, Homo Sapiens
gagagcgagaccugggaggga

SEQ ID NO: 5423 - RNA, 24 nt, Homo Sapiens
gcugccucugggaagucugcagua

SEQ ID NO: 5424 - RNA, 18 nt, Homo Sapiens
gcugcugcuggucugacu

SEQ ID NO: 5425 - RNA, 22 nt, Homo Sapiens
ggaaggagccaggauggccugg

SEQ ID NO: 5426 - RNA, 26 nt, Homo Sapiens
ggaggaguccaggccauggaggcaga

SEQ ID NO: 5427 - RNA, 22 nt, Homo Sapiens
gccaggauggccugggcucuga

SEQ ID NO: 5428 - RNA, 19 nt, Homo Sapiens
ggcugcugcuggucugacu

SEQ ID NO: 5429 - RNA, 27 nt, Homo Sapiens
gggagagagcgagaccugggagggagg

SEQ ID NO: 5430 - RNA, 22 nt, Homo Sapiens
caguucugcagcuguuuuaguu

SEQ ID NO: 5431 - RNA, 26 nt, Homo Sapiens
ccaguggcugcuccuuccuucaccuc

SEQ ID NO: 5432 - RNA, 22 nt, Homo Sapiens
aguccaggccauggaggcagaa

SEQ ID NO: 5433 - RNA, 24 nt, Homo Sapiens
aggucugcaagaaccugacucguc

SEQ ID NO: 5434 - RNA, 28 nt, Homo Sapiens
aucauacugaaguagagugcggcguuuc

SEQ ID NO: 5435 - RNA, 25 nt, Homo Sapiens
aaggucugcaagaaccugacucguc

SEQ ID NO: 5436 - RNA, 22 nt, Homo Sapiens
acagagcagugcuagucgggcu

SEQ ID NO: 5437 - RNA, 24 nt, Homo Sapiens
acaggaagaucuuaaauuuuguga

SEQ ID NO: 5438 - RNA, 22 nt, Homo Sapiens
accagccuggguaacauaguga

SEQ ID NO: 5439 - RNA, 21 nt, Homo Sapiens
aauguacaccuguggucccag

SEQ ID NO: 5440 - RNA, 22 nt, Homo Sapiens
acgccuguaauccuagcacuuu

SEQ ID NO: 5441 - RNA, 22 nt, Homo Sapiens
acuauuccuuugcccggcauca

SEQ ID NO: 5442 - RNA, 22 nt, Homo Sapiens
aggaaccugcuuuaguggggga

SEQ ID NO: 5443 - RNA, 22 nt, Homo Sapiens
agaccagccuggguaacauagu

SEQ ID NO: 5444 - RNA, 25 nt, Homo Sapiens
auccuagcacuuuugggaggcagag

SEQ ID NO: 5445 - RNA, 20 nt, Homo Sapiens
agugagacccuaucucuaca

SEQ ID NO: 5446 - RNA, 19 nt, Homo Sapiens
aggcuaaggugggaggauc

SEQ ID NO: 5447 - RNA, 27 nt, Homo Sapiens
auuccuuugcccggcaucaaggcacag

SEQ ID NO: 5448 - RNA, 22 nt, Homo Sapiens
cacgccuguaauccuagcacuu

SEQ ID NO: 5449 - RNA, 25 nt, Homo Sapiens
caccacugcgcccuucucccugagg

SEQ ID NO: 5450 - RNA, 18 nt, Homo Sapiens
ccauagcaacacucugag

SEQ ID NO: 5451 - RNA, 27 nt, Homo Sapiens
ccaggcauuugagaccagccuggguaa

SEQ ID NO: 5452 - RNA, 31 nt, Homo Sapiens
ccaggcauuugagaccagccuggguaacaua

SEQ ID NO: 5453 - RNA, 26 nt, Homo Sapiens
cccaccaggaaccugcuuuagugggg

SEQ ID NO: 5454 - RNA, 26 nt, Homo Sapiens
ccauuuuaaagguugaggaaacaagc

SEQ ID NO: 5455 - RNA, 25 nt, Homo Sapiens
cccugaggagccucagcuuucccuc

SEQ ID NO: 5456 - RNA, 26 nt, Homo Sapiens
caggcauuugagaccagccuggguaa

SEQ ID NO: 5457 - RNA, 20 nt, Homo Sapiens
gggaggaguuccugcccacc

SEQ ID NO: 5458 - RNA, 17 nt, Homo Sapiens
ggccucggcccggagcg

SEQ ID NO: 5459 - RNA, 23 nt, Homo Sapiens
ggugcucacgccuguaauccuag

SEQ ID NO: 5460 - RNA, 22 nt, Homo Sapiens
gguccaagccuccccuccacca

SEQ ID NO: 5461 - RNA, 22 nt, Homo Sapiens
gccacugcggggaggaggggga

SEQ ID NO: 5462 - RNA, 23 nt, Homo Sapiens
gccuguaauccuagcacuuuugg

SEQ ID NO: 5463 - RNA, 26 nt, Homo Sapiens
gccuguaauccuagcacuuuugggag

SEQ ID NO: 5464 - RNA, 21 nt, Homo Sapiens
gcccuucucccugaggagccu

SEQ ID NO: 5465 - RNA, 22 nt, Homo Sapiens
ggaggcuaaggugggaggauca

SEQ ID NO: 5466 - RNA, 26 nt, Homo Sapiens
ggaggaaggagucgccgaggagcagc

SEQ ID NO: 5467 - RNA, 23 nt, Homo Sapiens
gcugggagccggaggcgcgggga

SEQ ID NO: 5468 - RNA, 22 nt, Homo Sapiens
gcucacgccuguaauccuagca

SEQ ID NO: 5469 - RNA, 26 nt, Homo Sapiens
gagacacccccgguccaagccucccc

SEQ ID NO: 5470 - RNA, 22 nt, Homo Sapiens
gaccagccuggguaacauagug

SEQ ID NO: 5471 - RNA, 27 nt, Homo Sapiens
gcaccuugggcacuguugaagugccuu

SEQ ID NO: 5472 - RNA, 26 nt, Homo Sapiens
cugggagccggaggcgcggggaccuc

SEQ ID NO: 5473 - RNA, 24 nt, Homo Sapiens
cugccuccuccugccugucugcac

SEQ ID NO: 5474 - RNA, 23 nt, Homo Sapiens
cucucugccuccuccugccuguc

SEQ ID NO: 5475 - RNA, 18 nt, Homo Sapiens
cuccuccugccugucugc

SEQ ID NO: 5476 - RNA, 22 nt, Homo Sapiens
cuccuccugccugucugcacua

SEQ ID NO: 5477 - RNA, 22 nt, Homo Sapiens
cuccugagcccccgcgcauccu

SEQ ID NO: 5478 - RNA, 24 nt, Homo Sapiens
cgcugggagccggaggcgcgggga

SEQ ID NO: 5479 - RNA, 21 nt, Homo Sapiens
cgccuguaauccuagcacuuu

SEQ ID NO: 5480 - RNA, 22 nt, Homo Sapiens
cgccuguaauccuagcacuuuu

SEQ ID NO: 5481 - RNA, 22 nt, Homo Sapiens
ccuguaauccuagcacuuuugg

SEQ ID NO: 5482 - RNA, 23 nt, Homo Sapiens
ccucucugccuccuccugccugu

SEQ ID NO: 5483 - RNA, 22 nt, Homo Sapiens
uaacauagugagacccuaucuc

SEQ ID NO: 5484 - RNA, 21 nt, Homo Sapiens
uccuccugccugucugcacua

SEQ ID NO: 5485 - RNA, 25 nt, Homo Sapiens
uccaggcauuugagaccagccuggg

SEQ ID NO: 5486 - RNA, 20 nt, Homo Sapiens
uggaggcuaaggugggagga

SEQ ID NO: 5487 - RNA, 22 nt, Homo Sapiens
ugggagccggaggcgcggggac

SEQ ID NO: 5488 - RNA, 24 nt, Homo Sapiens
ucugccuccuccugccugucugca

SEQ ID NO: 5489 - RNA, 23 nt, Homo Sapiens
ugcggggaggagggggaggagga

SEQ ID NO: 5490 - RNA, 21 nt, Homo Sapiens
uugggaggcagagaugggagg

SEQ ID NO: 5491 - RNA, 27 nt, Homo Sapiens
ugucauugucuguccccacccggucgu

SEQ ID NO: 5492 - RNA, 22 nt, Homo Sapiens
ucuccucucugggaaacguccc

SEQ ID NO: 5493 - RNA, 20 nt, Homo Sapiens
cggcugucuugccucuuguc

SEQ ID NO: 5494 - RNA, 21 nt, Homo Sapiens
gcggcugucuugccucuuguc

SEQ ID NO: 5495 - RNA, 24 nt, Homo Sapiens
gcacugcgacugcccagucuggcc

SEQ ID NO: 5496 - RNA, 23 nt, Homo Sapiens
gguggaaggagggagggagccgc

SEQ ID NO: 5497 - RNA, 28 nt, Homo Sapiens
gguggaaggagggagggagccgcaggcg

SEQ ID NO: 5498 - RNA, 21 nt, Homo Sapiens
ggcacagugccugggacuggc

SEQ ID NO: 5499 - RNA, 27 nt, Homo Sapiens
ggcacagugccugggacuggcagggug

SEQ ID NO: 5500 - RNA, 28 nt, Homo Sapiens
ggggcaggcucuggcacagugccuggga

SEQ ID NO: 5501 - RNA, 21 nt, Homo Sapiens
gcuccccaggggaguuguguc

SEQ ID NO: 5502 - RNA, 24 nt, Homo Sapiens
ggaccuuaggccuuccucucucca

SEQ ID NO: 5503 - RNA, 25 nt, Homo Sapiens
ccuggccucugugccuucuuuugau

SEQ ID NO: 5504 - RNA, 21 nt, Homo Sapiens
ccuuaggccuuccucucucca

SEQ ID NO: 5505 - RNA, 20 nt, Homo Sapiens
cuggaaucuggagaccaggg

SEQ ID NO: 5506 - RNA, 27 nt, Homo Sapiens
cuucccaaacgccuccccugccccaau

SEQ ID NO: 5507 - RNA, 20 nt, Homo Sapiens
cuuaggccuuccucucucca

SEQ ID NO: 5508 - RNA, 21 nt, Homo Sapiens
cuugagacacggagcccagcc

SEQ ID NO: 5509 - RNA, 26 nt, Homo Sapiens
gagaauugggggcuuagggucggaac

SEQ ID NO: 5510 - RNA, 23 nt, Homo Sapiens
gaccuuaggccuuccucucucca

SEQ ID NO: 5511 - RNA, 21 nt, Homo Sapiens
cccucagcaaggacagcagag

SEQ ID NO: 5512 - RNA, 26 nt, Homo Sapiens
cccucucuccccuggaaaggacacca

SEQ ID NO: 5513 - RNA, 27 nt, Homo Sapiens
ccagcucccucuauuuauguuugcacu

SEQ ID NO: 5514 - RNA, 21 nt, Homo Sapiens
cacuggggccuacagcuuuga

SEQ ID NO: 5515 - RNA, 21 nt, Homo Sapiens
agugcuggcaaccacuaagaa

SEQ ID NO: 5516 - RNA, 28 nt, Homo Sapiens
aggaauguguggccugcacagugaagug

SEQ ID NO: 5517 - RNA, 22 nt, Homo Sapiens
acucacuggggccuacagcuuu

SEQ ID NO: 5518 - RNA, 21 nt, Homo Sapiens
accuuaggccuuccucucucc

SEQ ID NO: 5519 - RNA, 27 nt, Homo Sapiens
uccacccucucuccccuggaaaggaca

SEQ ID NO: 5520 - RNA, 23 nt, Homo Sapiens
ugcuggcaaccacuaagaauuca

SEQ ID NO: 5521 - RNA, 22 nt, Homo Sapiens
uuccuugagacacggagcccag

SEQ ID NO: 5522 - RNA, 22 nt, Homo Sapiens
uggcuccaacacugcugcucca

SEQ ID NO: 5523 - RNA, 27 nt, Homo Sapiens
ucccgacgaucuuccuggcuccaacac

SEQ ID NO: 5524 - RNA, 20 nt, Homo Sapiens
uccuggcuccaacacugcug

SEQ ID NO: 5525 - RNA, 21 nt, Homo Sapiens
ucacccaggaggauggcaaag

SEQ ID NO: 5526 - RNA, 27 nt, Homo Sapiens
ucacccaggaggauggcaaagagaguc

SEQ ID NO: 5527 - RNA, 20 nt, Homo Sapiens
acaggagaccuggcacugga

SEQ ID NO: 5528 - RNA, 20 nt, Homo Sapiens
agugggcugcacccacccag

SEQ ID NO: 5529 - RNA, 26 nt, Homo Sapiens
aguuugagacaggagaccuggcacug

SEQ ID NO: 5530 - RNA, 26 nt, Homo Sapiens
cccgacgaucuuccuggcuccaacac

SEQ ID NO: 5531 - RNA, 19 nt, Homo Sapiens
caggagaccuggcacugga

SEQ ID NO: 5532 - RNA, 22 nt, Homo Sapiens
caggagagacagugaggcugca

SEQ ID NO: 5533 - RNA, 23 nt, Homo Sapiens
gagacaggagaccuggcacugga

SEQ ID NO: 5534 - RNA, 20 nt, Homo Sapiens
gcgugagggugaggggcugg

SEQ ID NO: 5535 - RNA, 27 nt, Homo Sapiens
ggggcaggggagucagcagaggccucg

SEQ ID NO: 5536 - RNA, 21 nt, Homo Sapiens
ggcuccaacacugcugcucca

SEQ ID NO: 5537 - RNA, 30 nt, Homo Sapiens
ggugaggggcuggcacugacugggcauagc

SEQ ID NO: 5538 - RNA, 21 nt, Homo Sapiens
gucacccaggaggauggcaaa

SEQ ID NO: 5539 - RNA, 27 nt, Homo Sapiens
gucacccaggaggauggcaaagagagu

SEQ ID NO: 5540 - RNA, 21 nt, Homo Sapiens
ggucacccaggaggauggcaa

SEQ ID NO: 5541 - RNA, 26 nt, Homo Sapiens
gugaaaaacaacaaauucaguucuga

SEQ ID NO: 5542 - RNA, 24 nt, Homo Sapiens
gugacacacagguguucaaagacg

SEQ ID NO: 5543 - RNA, 26 nt, Homo Sapiens
ggcaagacugcccuuagaaauucuag

SEQ ID NO: 5544 - RNA, 16 nt, Homo Sapiens
gcguaugacacauuga

SEQ ID NO: 5545 - RNA, 25 nt, Homo Sapiens
gccagcccuggcugcccaggcggag

SEQ ID NO: 5546 - RNA, 23 nt, Homo Sapiens
gacgcuucuggggagugagggaa

SEQ ID NO: 5547 - RNA, 23 nt, Homo Sapiens
gacaauguccaagacacagcaga

SEQ ID NO: 5548 - RNA, 24 nt, Homo Sapiens
cuuugccaccucuccauuuuugcc

SEQ ID NO: 5549 - RNA, 21 nt, Homo Sapiens
cugcccuuagaaauucuagcc

SEQ ID NO: 5550 - RNA, 18 nt, Homo Sapiens
cuggcucaaaacuaccua

SEQ ID NO: 5551 - RNA, 25 nt, Homo Sapiens
cgcaagagugacacacagguguuca

SEQ ID NO: 5552 - RNA, 24 nt, Homo Sapiens
auguccaagacacagcagaacaga

SEQ ID NO: 5553 - RNA, 21 nt, Homo Sapiens
augcagaaagcacagaaagga

SEQ ID NO: 5554 - RNA, 21 nt, Homo Sapiens
auguaaacugugaagauaguu

SEQ ID NO: 5555 - RNA, 26 nt, Homo Sapiens
auggaaagaaagaagcguaugacaca

SEQ ID NO: 5556 - RNA, 27 nt, Homo Sapiens
auggaaagaaagaagcguaugacacau

SEQ ID NO: 5557 - RNA, 21 nt, Homo Sapiens
auuuaaauaaggcucuaccuc

SEQ ID NO: 5558 - RNA, 22 nt, Homo Sapiens
acaauguccaagacacagcaga

SEQ ID NO: 5559 - RNA, 19 nt, Homo Sapiens
uccucaaggacauuacuag

SEQ ID NO: 5560 - RNA, 23 nt, Homo Sapiens
ucucaggcaucaaaagcauuuug

SEQ ID NO: 5561 - RNA, 26 nt, Homo Sapiens
uccaaggauguuuaaaaucuaguugg

SEQ ID NO: 5562 - RNA, 25 nt, Homo Sapiens
ugggugaagagaaaggaaguacaga

SEQ ID NO: 5563 - RNA, 24 nt, Homo Sapiens
ucuuucucaggcaucaaaagcauu

SEQ ID NO: 5564 - RNA, 26 nt, Homo Sapiens
uugggugaagagaaaggaaguacaga

SEQ ID NO: 5565 - RNA, 25 nt, Homo Sapiens
uuuccacccugucccuaucucuacc

SEQ ID NO: 5566 - RNA, 21 nt, Homo Sapiens
uucaguuuuguuucuuugcgu

SEQ ID NO: 5567 - RNA, 26 nt, Homo Sapiens
ucagugaagaugcagaagggaaaugg

SEQ ID NO: 5568 - RNA, 23 nt, Homo Sapiens
auuacaggucacaugaaaccaaa

SEQ ID NO: 5569 - RNA, 27 nt, Homo Sapiens
aguucucuucuuuccacccugucccua

SEQ ID NO: 5570 - RNA, 24 nt, Homo Sapiens
auccagagaguccuaugaaaagac

SEQ ID NO: 5571 - RNA, 32 nt, Homo Sapiens
cagguugaauucugaguaaacagcagauaacu

SEQ ID NO: 5572 - RNA, 22 nt, Homo Sapiens
caugaaaccaaaacgggcccug

SEQ ID NO: 5573 - RNA, 21 nt, Homo Sapiens
cggacaguuauucauucucuu

SEQ ID NO: 5574 - RNA, 20 nt, Homo Sapiens
cuaugaaaagacaaggccau

SEQ ID NO: 5575 - RNA, 20 nt, Homo Sapiens
cuccuuauggagaacuauuu

SEQ ID NO: 5576 - RNA, 21 nt, Homo Sapiens
cucugccagaagauaccauuu

SEQ ID NO: 5577 - RNA, 23 nt, Homo Sapiens
cuugcaggcugugguggagcuga

SEQ ID NO: 5578 - RNA, 26 nt, Homo Sapiens
gcagaagggaaauggggagccucagc

SEQ ID NO: 5579 - RNA, 25 nt, Homo Sapiens
ggagaacuauuuauuauacacucca

SEQ ID NO: 5580 - RNA, 24 nt, Homo Sapiens
ggcugugguggagcugacgcuggg

SEQ ID NO: 5581 - RNA, 22 nt, Homo Sapiens
ggcugugugacggcugccugaa

SEQ ID NO: 5582 - RNA, 22 nt, Homo Sapiens
gggcacugucugaacuccugac

SEQ ID NO: 5583 - RNA, 29 nt, Homo Sapiens
gggagggagcucuuucucuggcccugcag

SEQ ID NO: 5584 - RNA, 25 nt, Homo Sapiens
gggcagcaggccugguugcagcugg

SEQ ID NO: 5585 - RNA, 24 nt, Homo Sapiens
ggccccagccaagggacacaucuc

SEQ ID NO: 5586 - RNA, 32 nt, Homo Sapiens
ggccuggcuggcucuucugugcuuuccacaaa

SEQ ID NO: 5587 - RNA, 26 nt, Homo Sapiens
ggcgguggagacuucccugugcggug

SEQ ID NO: 5588 - RNA, 25 nt, Homo Sapiens
gugccucaacauggagccuugccug

SEQ ID NO: 5589 - RNA, 21 nt, Homo Sapiens
gucugaacuccugacugucag

SEQ ID NO: 5590 - RNA, 24 nt, Homo Sapiens
ggucaaggugacccgggaggagag

SEQ ID NO: 5591 - RNA, 25 nt, Homo Sapiens
gcuggcgugggggucucagaaugga

SEQ ID NO: 5592 - RNA, 22 nt, Homo Sapiens
gcuggcucuucugugcuuucca

SEQ ID NO: 5593 - RNA, 26 nt, Homo Sapiens
gcagaagcucucccucccuacucccu

SEQ ID NO: 5594 - RNA, 19 nt, Homo Sapiens
gcagcugggaacaugugca

SEQ ID NO: 5595 - RNA, 24 nt, Homo Sapiens
gcagcugggaacaugugcaggcug

SEQ ID NO: 5596 - RNA, 22 nt, Homo Sapiens
gccaggaugcaggcauccacau

SEQ ID NO: 5597 - RNA, 21 nt, Homo Sapiens
gcgagcuggagagaggacugu

SEQ ID NO: 5598 - RNA, 23 nt, Homo Sapiens
cuugccuggccugggcuaggggc

SEQ ID NO: 5599 - RNA, 23 nt, Homo Sapiens
cugcagaugaccucaugaacugg

SEQ ID NO: 5600 - RNA, 22 nt, Homo Sapiens
cugccuggccacugagcacugg

SEQ ID NO: 5601 - RNA, 26 nt, Homo Sapiens
cugccuggccacugagcacuggccga

SEQ ID NO: 5602 - RNA, 27 nt, Homo Sapiens
cugccuggccacugagcacuggccgag

SEQ ID NO: 5603 - RNA, 21 nt, Homo Sapiens
gaggugccucaacauggagcc

SEQ ID NO: 5604 - RNA, 22 nt, Homo Sapiens
cucucuagccacccccuugucc

SEQ ID NO: 5605 - RNA, 20 nt, Homo Sapiens
cugacacguccagggccagg

SEQ ID NO: 5606 - RNA, 20 nt, Homo Sapiens
cucacgcagcugggaacaug

SEQ ID NO: 5607 - RNA, 27 nt, Homo Sapiens
cggcuccaguccauagacguucccccc

SEQ ID NO: 5608 - RNA, 24 nt, Homo Sapiens
cggugagcuuccugcagccugugg

SEQ ID NO: 5609 - RNA, 21 nt, Homo Sapiens
ccuggccaggacucaggcugu

SEQ ID NO: 5610 - RNA, 26 nt, Homo Sapiens
ccuggccaggacucaggcuguuccug

SEQ ID NO: 5611 - RNA, 17 nt, Homo Sapiens
ccugcagccccucagcc

SEQ ID NO: 5612 - RNA, 20 nt, Homo Sapiens
ccaagacauuaaaucugcca

SEQ ID NO: 5613 - RNA, 20 nt, Homo Sapiens
cccaggccugucaagagacg

SEQ ID NO: 5614 - RNA, 25 nt, Homo Sapiens
cccugccacucuccccaagagggcc

SEQ ID NO: 5615 - RNA, 22 nt, Homo Sapiens
cccaaguuucuccucugaccca

SEQ ID NO: 5616 - RNA, 22 nt, Homo Sapiens
cccagccaagggacacaucuca

SEQ ID NO: 5617 - RNA, 26 nt, Homo Sapiens
agggcagcaggccugguugcagcugg

SEQ ID NO: 5618 - RNA, 21 nt, Homo Sapiens
agucugcugcagaugaccuca

SEQ ID NO: 5619 - RNA, 19 nt, Homo Sapiens
augcaggcauccacaugcc

SEQ ID NO: 5620 - RNA, 23 nt, Homo Sapiens
cacuacugcugugcccucaggcu

SEQ ID NO: 5621 - RNA, 26 nt, Homo Sapiens
accaugucgcuggcagcuggugcugg

SEQ ID NO: 5622 - RNA, 20 nt, Homo Sapiens
agccucaucuuccugucucu

SEQ ID NO: 5623 - RNA, 24 nt, Homo Sapiens
aagcucucccucccuacucccugg

SEQ ID NO: 5624 - RNA, 26 nt, Homo Sapiens
ucucuagccacccccuuguccccagu

SEQ ID NO: 5625 - RNA, 22 nt, Homo Sapiens
uccucucagaacaucagccuca

SEQ ID NO: 5626 - RNA, 19 nt, Homo Sapiens
ucaacauggagccuugccu

SEQ ID NO: 5627 - RNA, 27 nt, Homo Sapiens
ucugaucuauuucaccaaccaccccau

SEQ ID NO: 5628 - RNA, 26 nt, Homo Sapiens
ugcagccuguggauguccugcagccc

SEQ ID NO: 5629 - RNA, 23 nt, Homo Sapiens
uggagagaggacuguccugaggg

SEQ ID NO: 5630 - RNA, 21 nt, Homo Sapiens
uucuccucugacccaucagcu

SEQ ID NO: 5631 - RNA, 23 nt, Homo Sapiens
uuacucugcacuauagccauuug

SEQ ID NO: 5632 - RNA, 28 nt, Homo Sapiens
uuacucugcacuauagccauuugcccca

SEQ ID NO: 5633 - RNA, 22 nt, Homo Sapiens
uuacaaguuucaguaauagcug

SEQ ID NO: 5634 - RNA, 23 nt, Homo Sapiens
uguggguggacgugguuggugau

SEQ ID NO: 5635 - RNA, 27 nt, Homo Sapiens
uguggguggacgugguuggugauuggc

SEQ ID NO: 5636 - RNA, 21 nt, Homo Sapiens
aaccuguucaaaauguuaaua

SEQ ID NO: 5637 - RNA, 25 nt, Homo Sapiens
auggcauucgcagugcccagugaug

SEQ ID NO: 5638 - RNA, 21 nt, Homo Sapiens
gcauuacucugcacuauagcc

SEQ ID NO: 5639 - RNA, 22 nt, Homo Sapiens
guggguggacgugguuggugau

SEQ ID NO: 5640 - RNA, 26 nt, Homo Sapiens
guggguggacgugguuggugauuggc

SEQ ID NO: 5641 - RNA, 21 nt, Homo Sapiens
cacauucuacuucagcuuugg

SEQ ID NO: 5642 - RNA, 21 nt, Homo Sapiens
agguuugcaaagacugagugu

SEQ ID NO: 5643 - RNA, 26 nt, Homo Sapiens
uccacauucuacuucagcuuuggaug

SEQ ID NO: 5644 - RNA, 82 nt, Homo Sapiens
aaaaaugaaaggaaaaggaggggaggcagaugggaagaugacccuuuuacaaauguuucuucuccuuuuucuuucuguuuuu

SEQ ID NO: 5645 - RNA, 102 nt, Homo Sapiens
aaaagccauguuacagauggcucuccuuggauggcuauuccagucgguuuccggggcugacuggcccacuccauuuaggguguguagcugugaguguauuuu

SEQ ID NO: 5646 - RNA, 106 nt, Homo Sapiens
aaaauaaaauagaaaucauuauugucuaggcuuuuggagaagcauaugcugugaaaaugaucacggcugugcuccuaaaagccagucauguuucuguaacaguuuu

SEQ ID NO: 5647 - RNA, 77 nt, Homo Sapiens
aaacggaugggccugggggccacuuugcacaggguucuccagagcccugcccauccugccuccaccacuuccuguuu

SEQ ID NO: 5648 - RNA, 68 nt, Homo Sapiens
aaacguguggugauugaugcuuucauggacucuguugccccaaguccccaagccuuguaccagcguuu

SEQ ID NO: 5649 - RNA, 79 nt, Homo Sapiens
aaaggaugaaaagguggugucauguuuuggggagaaucuuacuucucaaauggaaauugcacuuuuugcugaauccuuu

SEQ ID NO: 5650 - RNA, 63 nt, Homo Sapiens
aaaggcagacggugaaugccuugagaaauuguucagauucaaggacaagcauuuguugccuuu

SEQ ID NO: 5651 - RNA, 108 nt, Homo Sapiens
aaagggggguguaguuauaaccagggucaucuuugaucucauuuggaaaacuucauuucaagauggaguugcaggugguccuuggggacugauucugcaagccccuuu

SEQ ID NO: 5652 - RNA, 72 nt, Homo Sapiens
aaauacaaauuccugggucuccuggcagacuugcuaaaucagaaucuccaggggauccuggaauugguguuu

SEQ ID NO: 5653 - RNA, 108 nt, Homo Sapiens
aaauagccauucccucgugcugcgacaguuccauuccuaaugcagacuuacaaaaacuagguguaaggcuggcauuagggugaggccaggaugagagcagggcuuuuu

SEQ ID NO: 5654 - RNA, 93 nt, Homo Sapiens
aaaucucucaaccacugcaagcuuuuaaaagucuggcgcaucuugacuuucuuuucaccuauaacagccagcuuggauucauuugagagauuu

SEQ ID NO: 5655 - RNA, 77 nt, Homo Sapiens
aaauuuugggggaauuuuacugcccuagaggacugguucuagccacuuucccagggcaguggaucucugcaaaguuu

SEQ ID NO: 5656 - RNA, 99 nt, Homo Sapiens
aaccuccagcacaccaccaaugaauagcaguaauaccagcauaauugucugcaguucugcugagauacgugcucuauuuuauuggcuuggcuguagguu

SEQ ID NO: 5657 - RNA, 66 nt, Homo Sapiens
aacguguggugauugaugcuuucauggacucuguugccccaaguccccaagccuuguaccagcguu

SEQ ID NO: 5658 - RNA, 84 nt, Homo Sapiens
aacuggucggugauuuagguaguuuccuguuguugggauccaccuuucucucgacagcacgacacugccuucauuacuucaguu

SEQ ID NO: 5659 - RNA, 81 nt, Homo Sapiens
aagaagaaagaaagcuggcuagggaccucaggaucucaagaacaucauggaauugaguucccuggguuuucuuuuugccuu

SEQ ID NO: 5660 - RNA, 96 nt, Homo Sapiens
aagacggcaaauauucuggggugaaggagguauaauggggaaacacauuuauuuuccccuuuuaaacuucccugcugccccagucuuugccuucuu

SEQ ID NO: 5661 - RNA, 95 nt, Homo Sapiens
aagagacuuuguagaugugauuaaauuaaggcucuugagauugggagauuauccuggauuaucagaguaggcuugauguaaucacaagaguccuu

SEQ ID NO: 5662 - RNA, 78 nt, Homo Sapiens
aagaggcaggcauucuggguaucagacauaaauccccucccaggaacuuuuguguccugacccagaggacuggcucuu

SEQ ID NO: 5663 - RNA, 110 nt, Homo Sapiens
aagaggccuaaaaguuuaaugccagaccuuaggggcaggauggagcagggcuaaaagaugucucuuugggccugucugccugcuuuccuuccuuccuuuucuuuccuuuu

SEQ ID NO: 5664 - RNA, 96 nt, Homo Sapiens
aagauugguggccaccacauucagucuccuucacagcuaaguguagccacauaacuaugcuuuggccacggggauaugaaugcuacuacuaauuuu

SEQ ID NO: 5665 - RNA, 79 nt, Homo Sapiens
aagcacuuacuucuuugcagaugagacugagacauaguuacaaagucucaguuuccucugcaaacaguuguaagugcuu

SEQ ID NO: 5666 - RNA, 89 nt, Homo Sapiens
aagcccuugacuggggcugcugccuuucucucagagaugcccugcccagugaggaggaaucuagagaggcagucuggccacaguugcuu

SEQ ID NO: 5667 - RNA, 91 nt, Homo Sapiens
aagcugggggcacuggcuucugcucuugcucuuucuucuggaaacauuauucuguuccuuuggacaugggcaaggguccugucccuaacuu

SEQ ID NO: 5668 - RNA, 100 nt, Homo Sapiens
aaggagggaaguuuaaauuuuguaauauggccuugguugcagaaguccugauacuaagguaauucuagcaaccuuaauauuuuacaguagauucccccuu

SEQ ID NO: 5669 - RNA, 92 nt, Homo Sapiens
aaggauguguucacugaagccuaccauacauaugugacccuuauuaguuacacauaaggcauuuuuaugguggucuuugcccccuuaucuuu

SEQ ID NO: 5670 - RNA, 94 nt, Homo Sapiens
aagguauuuucugagcugugagccugccuuccagugacauguucuaaaaauugcaaguuauuugaggaggcuuuacagccaauaggaaguucuu

SEQ ID NO: 5671 - RNA, 109 nt, Homo Sapiens
aagugcuggauauugcuaagaauucagguagucucgggaucuccagagucuccauacuaggacaggagaucuucagaaccuggaggaauggaaauagucuagucagcuu

SEQ ID NO: 5672 - RNA, 79 nt, Homo Sapiens
aaguguucuccugaggacccuuaggucagacagagaagcuuucucuuucugaugggaagggucaaaguggaaaucucuu

SEQ ID NO: 5673 - RNA, 78 nt, Homo Sapiens
aaucaaaaagguuugagcaaaggaugaacacaaucuacagucagauuaugucacuccuuugcccagaccuucuugauu

SEQ ID NO: 5674 - RNA, 105 nt, Homo Sapiens
aaugaaguggaaucaagguggcaagaaaauuuagaaucguuucugauagggacuuucccuuauccuaaauguguuuugaaggcacacguuauuuccauugucauu

SEQ ID NO: 5675 - RNA, 102 nt, Homo Sapiens
aaugcuggacauuuaucuggagcugcaggggguaaagugucauccuugggaaauucaaagcuggccuguaccugcugagagcaccagggauauggucacauu

SEQ ID NO: 5676 - RNA, 49 nt, Homo Sapiens
aauggcuagguaagggaagaugcauucauuuauucauucaacuaauauu

SEQ ID NO: 5677 - RNA, 129 nt, Homo Sapiens
aauguaaaccccuuaaagcagauguguguggggccuuaugaagaccaggauucugcgggugucaggggauugccccucuugacagagacuaggguuuuagacugaggcuuccugcaggguguucgcauu

SEQ ID NO: 5678 - RNA, 104 nt, Homo Sapiens
aauguucuggcacauaguaauuaauuaagaaaaucgagcacccuuaauuaccuagaaugcaggguuguuaguuuuuugguugacuuuuguuuugcuggggcauu

SEQ ID NO: 5679 - RNA, 114 nt, Homo Sapiens
aauguuuacugaguauucaccaggugcuggguggagaaagaagacuuaaagauucccuagacaucuccucuccccuagacucaggaccauggcacuuauuuucuagucaauauu

SEQ ID NO: 5680 - RNA, 92 nt, Homo Sapiens
acaaaugucuuuggccucugugccuuuccucagacuuucaggcccauugugagagagcuaggaagauacaggguugucaaguugacacaugu

SEQ ID NO: 5681 - RNA, 103 nt, Homo Sapiens
acaauagucuaagagcuaacuaguugcacuugucuuuacccuagaggcuugcuaaauaaagcauacuuucuggagggcaagugcaggggucgcuucuguuugu

SEQ ID NO: 5682 - RNA, 91 nt, Homo Sapiens
acacacgugagauguguuccaggaagucgucuugagcacccauugcucagaguuuauauuggacuugcuuucuagcacauaccacaauugu

SEQ ID NO: 5683 - RNA, 104 nt, Homo Sapiens
acaccuccaaccucccugccuuugaacccuguguuaacaaugagaagcuuguuuauuugaaggcuggguucucauuggcccacagggguagguuguaauugugu

SEQ ID NO: 5684 - RNA, 85 nt, Homo Sapiens
acaccuccuguccaguacugucuugaugccugccccauaaagugacucugcgaugggcaaguguuaugaucagauuggagggugu

SEQ ID NO: 5685 - RNA, 93 nt, Homo Sapiens
acacugccucuagauuguuauuuuguccaagagagagaucauggagagagucucucucgcucacggaggcucugucuuucuaggaguaugugu

SEQ ID NO: 5686 - RNA, 90 nt, Homo Sapiens
acacuggacagauggauguugaugagcuugugugcagcaguucuacuggaaguauguacaaggggcucagccagccaauuuggacggugu

SEQ ID NO: 5687 - RNA, 74 nt, Homo Sapiens
acagagguugcagugagccgagauacauacauauauauguauauaucaugugcaacuuggcucugcuccuuugu

SEQ ID NO: 5688 - RNA, 77 nt, Homo Sapiens
acagcucaccugcaaggcuuucaacucugcugaccuucagagugucagagcagugccgaagcccaggacauggcugu

SEQ ID NO: 5689 - RNA, 94 nt, Homo Sapiens
acaggagaauugcuugaacccuggagguggagguugcagugagccgagauugcaccauugcacuccacccuaggcaacaagagcaaaacucugu

SEQ ID NO: 5690 - RNA, 92 nt, Homo Sapiens
acauauggcagaauggaagugauuucuccuaaugaaaaugaagugcucuuuugaguauuucuuguuuuauugagauuccuaucugcccuugu

SEQ ID NO: 5691 - RNA, 72 nt, Homo Sapiens
acaugucauauugagccuccuacugaacucagccacauauggaaguuugaaguggguccucgaaaugcaugu

SEQ ID NO: 5692 - RNA, 113 nt, Homo Sapiens
acauuauuaggaauuucaagagcugggcauguuggaguaugccugugaucucaguuacuuaggaggcugaggcagaaggauuacuugaggccaggaguuugagucuguagugu

SEQ ID NO: 5693 - RNA, 81 nt, Homo Sapiens
accagaggcucagagaauggcacagcuguccuguucuccacauuugaauaggccggacucaguuuucucugaguuuuuggu

SEQ ID NO: 5694 - RNA, 111 nt, Homo Sapiens
accagugguuagcagaugaggugaaagagaugggacagugacuguaucuguucugaugaaggagauugugcaguuacaugcguaacgucauuaaacuucauucuuccaggu

SEQ ID NO: 5695 - RNA, 73 nt, Homo Sapiens
acccacauucuuagcuuggcuucaguuucuuuccgggucuuacugagaggugaagccaggcuucugggugggu

SEQ ID NO: 5696 - RNA, 89 nt, Homo Sapiens
accuauucccuguggcuuaggugagcaugugaccaggccuggccuccugagucccacagcuuccuagccacagugauaaaagaaugggu

SEQ ID NO: 5697 - RNA, 82 nt, Homo Sapiens
accucaucucuacaaaaaauacgaaaauuagcugggugugguggcauguaccuguagucccagcuauuugagagacugaggu

SEQ ID NO: 5698 - RNA, 71 nt, Homo Sapiens
accucucauuucuccucaaugccacugcacugaugucaacugacuuagggcaggcaugagagaacugaggu

SEQ ID NO: 5699 - RNA, 104 nt, Homo Sapiens
accugccuauauuacauucauuuugaugguuuguaucucaaaggaguacagugaacgaaacuuguuuaaagauacaccggaaagaaaaagagaagaggcagagu

SEQ ID NO: 5700 - RNA, 85 nt, Homo Sapiens
accuucuuugcugccugggagaugcugcuaugggcguuuauuugaucugcuuguggcucaguuugcucagcagugaaaugaaggu

SEQ ID NO: 5701 - RNA, 109 nt, Homo Sapiens
accuugcugacagugguaauuguagugugaaaggcauaguguccucuugcuuaaucaugggauacagacugcucacuucuuaaaugguuaccuuugcaguuuaagaggu

SEQ ID NO: 5702 - RNA, 112 nt, Homo Sapiens
acuacuggguguauaaauguguuuguguguguauguauuuauagauguucuuuaagguacccuugaaaacucuacauuauguaugccacauaaugacauuucagucaguggu

SEQ ID NO: 5703 - RNA, 92 nt, Homo Sapiens
acuccagccuggccucugaccccaguucaauccgaccaugcccaagcccaagcgggccuuuccuccagaacugcuccggggccuggcugugu

SEQ ID NO: 5704 - RNA, 78 nt, Homo Sapiens
acucuauuuuauucaaauggcacuaugauaugaguucaaaaaauuuuugaaacaguguccuuuguuuugagauggagu

SEQ ID NO: 5705 - RNA, 91 nt, Homo Sapiens
acucuuaaaccuuuagaaaugcuacagcaucuagcuucucuagaucaauaaucacagaggcuuaagugcugaccucauaaagauaaagagu

SEQ ID NO: 5706 - RNA, 84 nt, Homo Sapiens
acucuugagcucccuccacuucugaggacguuuccugacacauucaacagcaucagcguccaaucaggagggagcucaaagagu

SEQ ID NO: 5707 - RNA, 112 nt, Homo Sapiens
acucuuugagaugacugguauugaauggagcagucuuugaaaggcaccaacccuuccuaacugaugguggucucuugaaagaggcucuuccaaauuugucuucugaaagugu

SEQ ID NO: 5708 - RNA, 87 nt, Homo Sapiens
acugaagccuccugccaauagucacaugagugagucuggaagugaaucuuucagcaccaucagaugacuguaucacuggcuuacagu

SEQ ID NO: 5709 - RNA, 92 nt, Homo Sapiens
acuggaaaucacugccauuuccaggagaucaccuauccuaguuuugaggaauagucauugagguggguuuccuuaauggcaucucuucuagu

SEQ ID NO: 5710 - RNA, 84 nt, Homo Sapiens
acuggagacacaucuaauggcugugcugaugucaagggacuuucuaaucauguucaucaguugauagcagaugcuguuuccagu

SEQ ID NO: 5711 - RNA, 99 nt, Homo Sapiens
acuuuuggcucauuuuuugaugcaugugaccugggauuauaaaugugaaauuagguuuacgaaaggauccagugucauugugcaucaugggcaaggagu

SEQ ID NO: 5712 - RNA, 130 nt, Homo Sapiens
agaaaaauuaguuaauauuuaaaaaacuguauugugcauuuuggcuucacauguuuaacuuuuuuuaagaaaaaaguugcaugaauggaaaaaaaaucuguauacaguaucuguaaaaacugucuuaucu

SEQ ID NO: 5713 - RNA, 94 nt, Homo Sapiens
agaacaagggcuaaauucaaaucaaauuuucccuguacccuaagaaaaauaauuaggccgggagauguuugacuaagugaguaggcauuguucu

SEQ ID NO: 5714 - RNA, 84 nt, Homo Sapiens
agaaucacuugaaccugggagguggagguugcagugagccgaaauugugccacugcacuccagucuaggugacagagcgagacu

SEQ ID NO: 5715 - RNA, 84 nt, Homo Sapiens
agaaucacuugaacgugggaggcagaggcugcagugagccgagaucgugccacugcacuccagccugggcaacagagugagacu

SEQ ID NO: 5716 - RNA, 84 nt, Homo Sapiens
agaaucgcuugaacccaggaggcacagguugcaguaggccgagauugugccacugcacuccagccuggguggcagagugagacu

SEQ ID NO: 5717 - RNA, 84 nt, Homo Sapiens
agaaucgcuugaacccaggaggcggagguugcagugagccaggaucacgccacuguacuccacccugggcgacagagcgagacu

SEQ ID NO: 5718 - RNA, 84 nt, Homo Sapiens
agaauugcucgaacccgggagacagagguugcagugagccgagauugugccacugcacuccagccugggcaacagagcgagacu

SEQ ID NO: 5719 - RNA, 79 nt, Homo Sapiens
agacacugaauuggacauugauuuccuuuucucugcgucgaaaugucaaggaaaguugcaagucugugauuuuguguuu

SEQ ID NO: 5720 - RNA, 113 nt, Homo Sapiens
agacagugcugggucaaacagccuuuauuuuagcaguugugagacccuagagaacuccuuugguguuuuggggucuccccagcaugcacaauggggguuaugcuagcaucucu

SEQ ID NO: 5721 - RNA, 86 nt, Homo Sapiens
agacaugucaaggcaggagccaucugaucgaccuuagacuuggcaagcugguggcuaaguccagugcucacugccgacaucugucu

SEQ ID NO: 5722 - RNA, 86 nt, Homo Sapiens
agaccaccuuauucuuuucuuauggguauguggcaugaaugccaucauuuauuuacccagcugccaguugaagaacauuuuggucu

SEQ ID NO: 5723 - RNA, 130 nt, Homo Sapiens
agacguggggucucgcuauguuggccagguuggucuugaacucuuggccucaagcauuccuccugccucagcuucccaaagugcuaggauuacagccaugagccaauaguaguaaaaugacuuuuuguuu

SEQ ID NO: 5724 - RNA, 93 nt, Homo Sapiens
agagagagucucacucugucgcccaggcuggagugcaguggugugaucucggcucacugcaaccucugccuuccggauucaagugauucuccu

SEQ ID NO: 5725 - RNA, 106 nt, Homo Sapiens
agagaggaaaugagaggagucggcuggggcgaguguggaccgcagcccagaguuagucuuggcugcagugcaacucuuucuaaaauguuauucucacgcccuuucu

SEQ ID NO: 5726 - RNA, 80 nt, Homo Sapiens
agagaugcuaaguuuagauuccagggggcaggacuggauuuuuaauuucaucuggcuccugaguccuagcuccuaauccu

SEQ ID NO: 5727 - RNA, 83 nt, Homo Sapiens
agagcugguguguagcggguaccuucugucugcuggcacuagguauuuuacacauuaaaucagcucguucucacaucagcucu

SEQ ID NO: 5728 - RNA, 78 nt, Homo Sapiens
agagcuuagguagacagacuugaccuuggagaggccagagaagccuucucugaggacagaaaguuugugcugaagucu

SEQ ID NO: 5729 - RNA, 84 nt, Homo Sapiens
agaggauugcuugagcccagggaggucaaggcugcagugauccaugauugcgccccuguacucugggcaacagagcaagacccu

SEQ ID NO: 5730 - RNA, 96 nt, Homo Sapiens
agagggagaauugcuugagcccaggauuucgaggcugcagugagcuaugaucacaccacugcacuccagccugggcaacagagcaagacucugucu

SEQ ID NO: 5731 - RNA, 115 nt, Homo Sapiens
agaggguugacauuagguuuggugagaugaguugcuuggcacagaucagcagaacaggacccuggugauaaggcaucuggcuuugcuaaccacuuaucaucuuccauuauucucu

SEQ ID NO: 5732 - RNA, 107 nt, Homo Sapiens
agagguguuccuuaggccacacccugcccucccuggacugccugaccucgcuccaaggcucaggggaagguucugagggcaggugugaaaaugcuuggaaugucccu

SEQ ID NO: 5733 - RNA, 124 nt, Homo Sapiens
agaguauaccugugcccgguugcuguagcucaugccuguaaucccaccacuuugggaggccaaggcggguggaucauuugagguuaguaguuugagaccagcuuggccaacauggggaaacucu

SEQ ID NO: 5734 - RNA, 109 nt, Homo Sapiens
agagucaccuaugaagcauuaaaauaauuaaagugucugaggccuuccccuucaauaaaucugggauugggcccaggcaacuguguuuuuuaagcacccagguuauucu

SEQ ID NO: 5735 - RNA, 86 nt, Homo Sapiens
agagucucauucuguugcccaggcaggagugcaauggugugaccucaggucacugcaaccucugcugccuggguucaagcgauucu

SEQ ID NO: 5736 - RNA, 86 nt, Homo Sapiens
agagucuugaucugucacccaggcugcaguguaguggcaugaucucggcucacugcaacccccgccuccuggguucaagccauucu

SEQ ID NO: 5737 - RNA, 97 nt, Homo Sapiens
agauccgugguccuuggagguuuuagggaaugaacaaauagaggccaguauuaggaggcuuagcuccagagauucuagaccuuggggucagggaucu

SEQ ID NO: 5738 - RNA, 113 nt, Homo Sapiens
agauguauuaugucuguccuugcggggguucuggucccugugucagucuuaacucucaugaauauagagguaguguuaagaggccagaacccuagggacgcuuuaaauucacu

SEQ ID NO: 5739 - RNA, 102 nt, Homo Sapiens
agaugugcuuccuguccucaguaaagaacuuggaguauguuguuccucaaauaucuuuugaugaaugggugcuccaggaguuucuacugacaggcuacauuu

SEQ ID NO: 5740 - RNA, 113 nt, Homo Sapiens
agauuuuuucugauacuacauauugucaguuuuuuaaauacucaguuugugcuaaaagaaaacauucggcaacugauaucugcuguucuguauguaucugucaguccagauuu

SEQ ID NO: 5741 - RNA, 107 nt, Homo Sapiens
agcaaggacaaguugugaccuucccaguccucucuccauuugcagaucagcaagcuucugucagcaaggagggguggacaaugaaacuggguucagcuugauuuguu

SEQ ID NO: 5742 - RNA, 83 nt, Homo Sapiens
agcagacugaacuaagacacccucugccugugguugucuuggcaaagccagguaaugcaggagagggguggacucagccugcu

SEQ ID NO: 5743 - RNA, 101 nt, Homo Sapiens
agcagacugcccuguugaccagaauuuguuagauugcuauuacaaugcugauuauauuuuauagcaauuacugacauaagguuauacuuugggcaauggcu

SEQ ID NO: 5744 - RNA, 71 nt, Homo Sapiens
agcagaggcuggggaauggggguucugcucucacugaaugguggggaaccuucaacugcuuagccugugcu

SEQ ID NO: 5745 - RNA, 57 nt, Homo Sapiens
agcagcacagaaauauuggcacagggaagcgagucugccaauauuggcugugcugcu

SEQ ID NO: 5746 - RNA, 92 nt, Homo Sapiens
agcaggauuaggaagagaagcauugugagaaacagguuuuggguuuugcugaaauuugcuugucagcauugcaucacuuuuccuuaacuguu

SEQ ID NO: 5747 - RNA, 88 nt, Homo Sapiens
agcauaugacagcaagacacuggcccuggaauccuccgugucacaugugggcugcugacaggaagaaugugcuuuuguuguuguuguu

SEQ ID NO: 5748 - RNA, 100 nt, Homo Sapiens
agccauucccucgugcugcgacaguuccauuccuaaugcagacuuacaaaaacuagguguaaggcuggcauuagggugaggccaggaugagagcagggcu

SEQ ID NO: 5749 - RNA, 94 nt, Homo Sapiens
agcccuaauaucuauaauuugaacuguacuggacccauaguuuuaacugaaaagggccaaacaaguggugucuguccaguuccuggacugggcu

SEQ ID NO: 5750 - RNA, 95 nt, Homo Sapiens
agccugggucacuguaugguaccagugucagcuuccuguguuacacgagauggcacaguugggugaagcuggugaugaagguaugugaccccucu

SEQ ID NO: 5751 - RNA, 83 nt, Homo Sapiens
agcggugaagaccaaggccagagcuuaaacucauaggggucauucaacucuguuuuuauuaguuguccuugguuuauacuguu

SEQ ID NO: 5752 - RNA, 114 nt, Homo Sapiens
agcuauugugacaaucuugguuaccauccauuaagugcugcugauuuuggaaagaucaugaaaaacgucuuuccaaacaugaaggcacgucguuugggcacaagaggcaaaucu

SEQ ID NO: 5753 - RNA, 90 nt, Homo Sapiens
agcugcagcucuuucuucccuaugagcuuggacacaucaauccuaaacuaggagugugaaggaggaagggaggagcagggagcagcaguu

SEQ ID NO: 5754 - RNA, 109 nt, Homo Sapiens
aggaagaggcuggcuguguggaugagagcaacuugcuuuuuacaauaauuauuuguuauuguaaauuaacaauuugcucuucugguauuauauggaaguauuugauccu

SEQ ID NO: 5755 - RNA, 88 nt, Homo Sapiens
aggaagauugugugaguccaggaauuggaggcugcagugagcuauaauugugccaacuguacuccagccugggcaacaguuagacccu

SEQ ID NO: 5756 - RNA, 125 nt, Homo Sapiens
aggaauguggaaaaaccuuuauuuguggcucagaccuuacucgacaucacagaauucacacuggugagaaacccuaugaauguaaggaaugugggaaagccuuuaguagugguucaaacuucacu

SEQ ID NO: 5757 - RNA, 85 nt, Homo Sapiens
aggaauuugucagaaacucuuuccuguuuugguuuggagaguaguucucucuaacuagagacaggaguggccuugaaauuuuccu

SEQ ID NO: 5758 - RNA, 86 nt, Homo Sapiens
aggagggaaaggcccaggagggggagaaaggcagacucagccagggaugggugaggguuucccugucccaaagcaagacccaagcu

SEQ ID NO: 5759 - RNA, 87 nt, Homo Sapiens
aggaucacuuaaggcccaggaguucgaggcuguagugagcuaugacugugucacugcacuucagccugggcaauggagcaagauccu

SEQ ID NO: 5760 - RNA, 86 nt, Homo Sapiens
aggaucacuugagcccaggaguuggaggcugcagugagcuaugauugcacuacugcacuccagccugggcaacagagcaagauccu

SEQ ID NO: 5761 - RNA, 86 nt, Homo Sapiens
aggaucacuugagccugguaugucgaggcugcagugagcuaugaucgugccacugcacuccaaccaggcugaccgagccagacccu

SEQ ID NO: 5762 - RNA, 86 nt, Homo Sapiens
aggauugcuugagccuggaagcuggagccugcagugaacuaucauugugccacuguacuccagccuaggcaacaaaaugaaauccu

SEQ ID NO: 5763 - RNA, 93 nt, Homo Sapiens
aggcaaggucucacucggucauccagguuggaaugcaguggugugaucacaguucacuguaaacucaaacuccugggcucaaggaaucuuccu

SEQ ID NO: 5764 - RNA, 104 nt, Homo Sapiens
aggcacacacgcaugguuuucucuuuuauaugcuagauuucaucccugacagcagaaaaugauuggcaaugguuaugacggagaacaugcaauagcgugguccu

SEQ ID NO: 5765 - RNA, 94 nt, Homo Sapiens
aggcaccuagagacuucacaagcuaauggcagucccuggagcaggaagcaacuuguuauucugcucaagagaauccaccagcagcucuuggccu

SEQ ID NO: 5766 - RNA, 98 nt, Homo Sapiens
aggcaccuggggguguagaccgggguggagccgcaugggcaccuggggguguagaccgggguggaacuauguaaacaucccacacacucaggugacuu

SEQ ID NO: 5767 - RNA, 97 nt, Homo Sapiens
aggcagaagaauugcuggaaucuaggaggcggagguugcagugagccaagaucgcgccacugcacuccagccugggcaacacagcgagacucugucu

SEQ ID NO: 5768 - RNA, 98 nt, Homo Sapiens
aggcaggagaauugcuugaacccaggagguggagguugcagggagucgagaucgugccacugcacuccagccugggcaaugagagcaaaacuccaucu

SEQ ID NO: 5769 - RNA, 97 nt, Homo Sapiens
aggcaggagaauugcuugaaccuggaaggcggagguugcagugagccaagauugugccacugcacuccagccugggcaacacagcgagacucugucu

SEQ ID NO: 5770 - RNA, 97 nt, Homo Sapiens
aggcaggagaauugcuugaaccugugaggcagagguugcagugagcugagaucaugccacagcacuucagccugagcgacagagcgagacuccaccu

SEQ ID NO: 5771 - RNA, 97 nt, Homo Sapiens
aggcaggagagucgcuggaaccugagaggcggagcuugcagugagccgagaucgcgccacugcacuccagccugggcaacacagcgagacuccgucu

SEQ ID NO: 5772 - RNA, 99 nt, Homo Sapiens
aggcaggaggaucacgugagcccaggaggugaaggcuacagugaagugagaucaugcaacuguacuucagccugggcaacagagcaagauucucuuucu

SEQ ID NO: 5773 - RNA, 72 nt, Homo Sapiens
aggcauugucuccaacauguaccacuggucuggcuuuuguuaggcccauuaauaguguacaugugacagccu

SEQ ID NO: 5774 - RNA, 76 nt, Homo Sapiens
aggccaucuuaaucggggccagagaugacacucucccccuguaacucagccuggcucugucuauugggaugugccu

SEQ ID NO: 5775 - RNA, 112 nt, Homo Sapiens
aggcccuggguggcgugagggggaaggugugugugugggguggcagggaggagaaggaaucugcucugugcuuauucuuguccccguuucuuuugcagccugcccacggcuu

SEQ ID NO: 5776 - RNA, 81 nt, Homo Sapiens
aggcgcuaaaccuaaggcuuuucugggaagagcuguuaagauuagacuguucucccaaaaagccaauaauucugagugucu

SEQ ID NO: 5777 - RNA, 97 nt, Homo Sapiens
aggcgugagaaucgcuugaaccuggaagguggugguugcagugagccgagauccugccacugcacuccagccugggcaaccaagcgagacucugccu

SEQ ID NO: 5778 - RNA, 130 nt, Homo Sapiens
aggcucacacagcaagucuuugucaaagcuuaggaauggaaguagguuguccccuccuagucaugggaucucuccaacucacuagacaaucuugcuuuacgugcugaugaacaugcucugugagcagccu

SEQ ID NO: 5779 - RNA, 83 nt, Homo Sapiens
aggcugagguaggaugauugcuagcuagaguccaggaguucaggauuaaaaugagcuaugaucauaccacugcacuccagccu

SEQ ID NO: 5780 - RNA, 78 nt, Homo Sapiens
aggcugagugcaguggugugaucucggcucacugcaagcucugccucccagguucacgccauuguccugccucagccu

SEQ ID NO: 5781 - RNA, 87 nt, Homo Sapiens
aggcugggaacauucagggcugcucaagcccaggguuggcaacccccacucccuccaacacaagcagcucaagucuucuccagaccu

SEQ ID NO: 5782 - RNA, 92 nt, Homo Sapiens
aggcugggaacugugacucguacuuguaauccuagugcuuugagaggcugaggcaggaggauugcuugagaccaggaguuugagaccagccu

SEQ ID NO: 5783 - RNA, 92 nt, Homo Sapiens
aggcugguucgucguuucugccucuccauucuugucuuuuuaauucuuuguguuauuugagauggaguuugagagggaauaugaacaagccu

SEQ ID NO: 5784 - RNA, 87 nt, Homo Sapiens
aggcuguaugcuguuaaugcuaaucgugauagggguuuuugccuccaacugacuccuacauauuagcauuaacaguguaugaugccu

SEQ ID NO: 5785 - RNA, 103 nt, Homo Sapiens
aggcuuuagaguagcaaaggccccagggaaugggcucuguugggacagcuugucuuugguuuccaguaguuacuccucccugaaggggucaagguugcuuccu

SEQ ID NO: 5786 - RNA, 112 nt, Homo Sapiens
agggaaaaaauucauaauucagacaggcucucggggcuucaccauacaacgccuuucuuguauuugguuaguuuuaugggccuggaguguugaccauguauuaauuuucucu

SEQ ID NO: 5787 - RNA, 98 nt, Homo Sapiens
agggagagucuuggggugaagagguuugagccuucuccugcucuguccguggagcaagucaaauaaaugcugagaccgucagcuccucauuucuccuu

SEQ ID NO: 5788 - RNA, 129 nt, Homo Sapiens
agggcaagauccucgcuccaaccguggcccguguucucuccuuuuguccccauagugugacuccgccaggaacuuggaauggcugaagacugugaaugagagucaugggucuguggaacgcucaucccu

SEQ ID NO: 5789 - RNA, 84 nt, Homo Sapiens
agggguuguccuuaaguucccucugccugcaguccugcuuuguuuuggacaaguaggagugacaagcaggucagcacagcccuu

SEQ ID NO: 5790 - RNA, 106 nt, Homo Sapiens
agggugcuguugcuucuaggucuuuugagagcauagagccaggaagcauacacacauuuuuggcuccugacuuuuugcucuuucccagguuauugaguuugccccu

SEQ ID NO: 5791 - RNA, 80 nt, Homo Sapiens
agggugugcacugggcaagggcagggcggcaggugucaggccggcuuggacaaugaaacccugaccuugcugcauuccuu

SEQ ID NO: 5792 - RNA, 88 nt, Homo Sapiens
aggucucauuuuguugcccaggcugggguacaguggugcaaguauggcucacugcagccuugaacucuuucugggcucaagugauccu

SEQ ID NO: 5793 - RNA, 91 nt, Homo Sapiens
aggucucauuuuguugcccaggcugggguacaguggugcaaguauggcucacugcagccuugaacucuuucugggcucaagugauccuccu

SEQ ID NO: 5794 - RNA, 100 nt, Homo Sapiens
aggugauggaugggcaugcagugaggucacuguuggaugucagacuggagcccgaccucagugacucucaccagggccucagacugugagccuggcaccu

SEQ ID NO: 5795 - RNA, 69 nt, Homo Sapiens
agguggcagagaggcaauaucaauccuucugcaucacacagugggaaaaguuugucucauugcaguucu

SEQ ID NO: 5796 - RNA, 80 nt, Homo Sapiens
agguggcagagaggcaauaucaauccuucugcaucacacagugggaaaaguuugucucauugcaguucucuuccaagccu

SEQ ID NO: 5797 - RNA, 94 nt, Homo Sapiens
agguucacacauuggugccuuugcugggacaaaaaagagacuuuccugaggguugucuuguuccaguuucucagccacucaccaugugauaccu

SEQ ID NO: 5798 - RNA, 119 nt, Homo Sapiens
agguucuggugaauucaggaugguauuuuugucuuugaauaguuucugguugcauuucuauagugggggugaagcuaggggaacuucugugaucuuccugaggucacuucaaagugccu

SEQ ID NO: 5799 - RNA, 106 nt, Homo Sapiens
agguugguaaaagugguuucuaacacaguaucucuucuuuuagguguucaguggaaucacacuuacaaaauuuggagggauugugguguuggcuuuugccaaaucu

SEQ ID NO: 5800 - RNA, 88 nt, Homo Sapiens
aguaucacuugaaccagggaggcagaggcugcaugcagugagccaagauugcaccacugcacucuaaccugggcaacagaaugauacu

SEQ ID NO: 5801 - RNA, 106 nt, Homo Sapiens
aguaucuggaauucuauugugugugagucugugcaggaacacaaugagucucaaagugaaaaaaacuuuggauuccugguuccuacagcacuuuuguucagauacu

SEQ ID NO: 5802 - RNA, 89 nt, Homo Sapiens
aguauuauuaagacuuuuccugggucugggcugugccuguugcugccucugagacaagucagccuaauacaggaaaagcuuaauucucu

SEQ ID NO: 5803 - RNA, 91 nt, Homo Sapiens
agucaccagaguccauuguauuagucuuauuuucaucaccgugggcguacccugugggaugauguuaaacguacucuagacucuguuggcu

SEQ ID NO: 5804 - RNA, 70 nt, Homo Sapiens
agucacuggaaaaugcuuacaggcaguagccaccaucauguggcacaaagugggcaucauccuagugucu

SEQ ID NO: 5805 - RNA, 88 nt, Homo Sapiens
aguccucuuaugcuguugacauuuccccaugugaugcuauugcuucucuuuggaggcuaagcaguaaaugggguuaacagcaagggcu

SEQ ID NO: 5806 - RNA, 82 nt, Homo Sapiens
agucucacucugucacccaggcuggagugcaguggcaugaucuugguucacugcaaccucugcuucugggauucaagagauu

SEQ ID NO: 5807 - RNA, 84 nt, Homo Sapiens
agucucacucugucuccuaggcuggagugcaguggcgugaucucaucucauugcaaccuccaccuccuggauucaagugauucu

SEQ ID NO: 5808 - RNA, 113 nt, Homo Sapiens
agucucacucuguugcccaggcugaagucaacggcaugaucucagcucacugcaaccuccaccuccuggguucaagcaauucucgugccucagccucccaaguagcuuggauu

SEQ ID NO: 5809 - RNA, 84 nt, Homo Sapiens
agucucacucuguugcccaggcuggagugcaguggugcgaucucagcucacugcaaccuccaccuccuggguucaagugauucu

SEQ ID NO: 5810 - RNA, 92 nt, Homo Sapiens
agucucucucuggcuggaccuggacugcagucacacucuaagagcuccucuuucuacaccucugccagugggcguucggucagagacaagcu

SEQ ID NO: 5811 - RNA, 80 nt, Homo Sapiens
agucuguuguuguaaacauccccgacuggaagcuguaagacacagcuaagcuuucagucagauguuugcugcuaccggcu

SEQ ID NO: 5812 - RNA, 82 nt, Homo Sapiens
agucuugcucugucacccaggcuggagugcaguggugccaucuuggcucacugcaaccuccgccuccccaguucaagugauu

SEQ ID NO: 5813 - RNA, 84 nt, Homo Sapiens
agucuugcucuguugccuaggcuggagugcagugaugcaauuuuggcucacugcaaccuccaccuccuggguucaagcauuucu

SEQ ID NO: 5814 - RNA, 101 nt, Homo Sapiens
agugagucacauuggcuacuggugaggaaggagcagaguugugggcugagacugaugcuguucagcaucugucuuccuugucaccaacauagaugaccacu

SEQ ID NO: 5815 - RNA, 73 nt, Homo Sapiens
aguggcaggugugcaaaucacaacuuggccucccaaacuaagguacaaaguugugagucacacgucugccacu

SEQ ID NO: 5816 - RNA, 124 nt, Homo Sapiens
agugguaaugccguguguugauagaaauauguaaucgaucuuuucuuuggugggcaauuagcaauauugaggaaaguuaaagauguauguaucccuaccacuugaaacaccuggaaaugccauu

SEQ ID NO: 5817 - RNA, 125 nt, Homo Sapiens
agugucuccagauugcacgaacauuucauuuuucacacagggucaccagaauaccaucaauuuuuugguaucacugucaaaagugauccuagcaccuucugaaauaacgugagcugccagauucu

SEQ ID NO: 5818 - RNA, 123 nt, Homo Sapiens
agugugaagacaaaagccacuuucuaaggaugguggagcagaaaggcaggaguccugcucccuggcaccaucauggagcaugcccagcccagaucugccccccucugaauuuccuguugcauu

SEQ ID NO: 5819 - RNA, 114 nt, Homo Sapiens
aguguuggguugacuugaauggaggugauuguuuuagaagaaggucagaagacuagauuugcuuuucucuccaauuugaaauaccucuucuauucgaggacacccaggaacauu

SEQ ID NO: 5820 - RNA, 94 nt, Homo Sapiens
aguucaaggcugccuccucucugucuucauuaugugaauugaauguggucacacaucuguguuggagcagaggcaggggcugcagcuuucagcu

SEQ ID NO: 5821 - RNA, 59 nt, Homo Sapiens
aguucacaguggcugaagcuguucccauaagacccugaaucuagcagccacuguguacu

SEQ ID NO: 5822 - RNA, 76 nt, Homo Sapiens
aguucagacauucuagacuguuccgucagacucaguuucaaaagagaaugugugggagaacagucuuuguccgacu

SEQ ID NO: 5823 - RNA, 96 nt, Homo Sapiens
aguucccacgugcauggagcuguaguuuuucccacauuccucuuaggagcugugccuaagaugcugcgcuagcaaccucuguauugugaaggaacu

SEQ ID NO: 5824 - RNA, 85 nt, Homo Sapiens
aguuccuaugugccccacaggaaagcgcccuuaaccacugaugaguguugauguuuuucugcacuagaaggcacuauguugaacu

SEQ ID NO: 5825 - RNA, 82 nt, Homo Sapiens
aguucuaggguacaugugcacaacaugcagguuuguuacauagguauacaugugcuauguuggugugcugcacccauuaacu

SEQ ID NO: 5826 - RNA, 86 nt, Homo Sapiens
aguucugcagggcugcugccucaacauuuuagguucugauagcuguauucucaguccuggagugacagguguagccugcaguuacu

SEQ ID NO: 5827 - RNA, 83 nt, Homo Sapiens
aguuuaagaauggcucauguaguacccagcuacucugggcgacugagcccaggguacucugggaucacuugagcccaggagcu

SEQ ID NO: 5828 - RNA, 101 nt, Homo Sapiens
aguuuaaggaugucgcaaagucuggguggccuucaguccaugaaagagaacacaucuguucuaucucaggcugaggucaucugcauccucaucaauaagcu

SEQ ID NO: 5829 - RNA, 85 nt, Homo Sapiens
aguuucacucuugucacccaggcuggagugcaguggugccaucuuggcucacugcaaccuccgccugccgaguucaagcgauucu

SEQ ID NO: 5830 - RNA, 107 nt, Homo Sapiens
aguuuggguaaugaagccacagagauuugcugauacauuugcuaggcacgacuucuggucauuuagaaagcuauuuuguggcuucaucaauaagguauuccccagcu

SEQ ID NO: 5831 - RNA, 82 nt, Homo Sapiens
aguuuuaggguacaugugcacaacaugcagguuuguuacauauguauacaugugccauguuggugugcugcacccauuaacu

SEQ ID NO: 5832 - RNA, 82 nt, Homo Sapiens; identical to SEQ ID NO: 5831

SEQ ID NO: 5833 - RNA, 82 nt, Homo Sapiens; identical to SEQ ID NO: 5831

SEQ ID NO: 5834 - RNA, 82 nt, Homo Sapiens; identical to SEQ ID NO: 5831

SEQ ID NO: 5835 - RNA, 82 nt, Homo Sapiens; identical to SEQ ID NO: 5831

SEQ ID NO: 5836 - RNA, 82 nt, Homo Sapiens; identical to SEQ ID NO: 5831

SEQ ID NO: 5837 - RNA, 82 nt, Homo Sapiens; identical to SEQ ID NO: 5831

SEQ ID NO: 5838 - RNA, 82 nt, Homo Sapiens; identical to SEQ ID NO: 5831

SEQ ID NO: 5839 - RNA, 82 nt, Homo Sapiens; identical to SEQ ID NO: 5831

SEQ ID NO: 5840 - RNA, 82 nt, Homo Sapiens; identical to SEQ ID NO: 5831

SEQ ID NO: 5841 - RNA, 82 nt, Homo Sapiens; identical to SEQ ID NO: 5831

SEQ ID NO: 5842 - RNA, 82 nt, Homo Sapiens; identical to SEQ ID NO: 5831

SEQ ID NO: 5843 - RNA, 82 nt, Homo Sapiens; identical to SEQ ID NO: 5831

SEQ ID NO: 5844 - RNA, 82 nt, Homo Sapiens; identical to SEQ ID NO: 5831

SEQ ID NO: 5845 - RNA, 82 nt, Homo Sapiens; identical to SEQ ID NO: 5831

SEQ ID NO: 5846 - RNA, 82 nt, Homo Sapiens; identical to SEQ ID NO: 5831

SEQ ID NO: 5847 - RNA, 82 nt, Homo Sapiens; identical to SEQ ID NO: 5831

SEQ ID NO: 5848 - RNA, 82 nt, Homo Sapiens; identical to SEQ ID NO: 5831

SEQ ID NO: 5849 - RNA, 82 nt, Homo Sapiens; identical to SEQ ID NO: 5831

SEQ ID NO: 5850 - RNA, 82 nt, Homo Sapiens; identical to SEQ ID NO: 5831

SEQ ID NO: 5851 - RNA, 82 nt, Homo Sapiens; identical to SEQ ID NO: 5831

SEQ ID NO: 5852 - RNA, 82 nt, Homo Sapiens; identical to SEQ ID NO: 5831

SEQ ID NO: 5853 - RNA, 82 nt, Homo Sapiens; identical to SEQ ID NO: 5831

SEQ ID NO: 5854 - RNA, 82 nt, Homo Sapiens; identical to SEQ ID NO: 5831

SEQ ID NO: 5855 - RNA, 82 nt, Homo Sapiens; identical to SEQ ID NO: 5831

SEQ ID NO: 5856 - RNA, 82 nt, Homo Sapiens; identical to SEQ ID NO: 5831

SEQ ID NO: 5857 - RNA, 82 nt, Homo Sapiens; identical to SEQ ID NO: 5831

SEQ ID NO: 5858 - RNA, 82 nt, Homo Sapiens; identical to SEQ ID NO: 5831

SEQ ID NO: 5859 - RNA, 82 nt, Homo Sapiens; identical to SEQ ID NO: 5831

SEQ ID NO: 5860 - RNA, 82 nt, Homo Sapiens; identical to SEQ ID NO: 5831

SEQ ID NO: 5861 - RNA, 82 nt, Homo Sapiens; identical to SEQ ID NO: 5831

SEQ ID NO: 5862 - RNA, 82 nt, Homo Sapiens; identical to SEQ ID NO: 5831

SEQ ID NO: 5863 - RNA, 82 nt, Homo Sapiens; identical to SEQ ID NO: 5831

SEQ ID NO: 5864 - RNA, 82 nt, Homo Sapiens; identical to SEQ ID NO: 5831

SEQ ID NO: 5865 - RNA, 82 nt, Homo Sapiens; identical to SEQ ID NO: 5831

SEQ ID NO: 5866 - RNA, 82 nt, Homo Sapiens; identical to SEQ ID NO: 5831

SEQ ID NO: 5867 - RNA, 82 nt, Homo Sapiens; identical to SEQ ID NO: 5831

SEQ ID NO: 5868 - RNA, 82 nt, Homo Sapiens; identical to SEQ ID NO: 5831

SEQ ID NO: 5869 - RNA, 82 nt, Homo Sapiens; identical to SEQ ID NO: 5831

SEQ ID NO: 5870 - RNA, 82 nt, Homo Sapiens; identical to SEQ ID NO: 5831

SEQ ID NO: 5871 - RNA, 82 nt, Homo Sapiens; identical to SEQ ID NO: 5831

SEQ ID NO: 5872 - RNA, 82 nt, Homo Sapiens; identical to SEQ ID NO: 5831

SEQ ID NO: 5873 - RNA, 82 nt, Homo Sapiens; identical to SEQ ID NO: 5831

SEQ ID NO: 5874 - RNA, 82 nt, Homo Sapiens; identical to SEQ ID NO: 5831

SEQ ID NO: 5875 - RNA, 82 nt, Homo Sapiens; identical to SEQ ID NO: 5831

SEQ ID NO: 5876 - RNA, 82 nt, Homo Sapiens; identical to SEQ ID NO: 5831

SEQ ID NO: 5877 - RNA, 82 nt, Homo Sapiens; identical to SEQ ID NO: 5831

SEQ ID NO: 5878 - RNA, 82 nt, Homo Sapiens; identical to SEQ ID NO: 5831

SEQ ID NO: 5879 - RNA, 82 nt, Homo Sapiens; identical to SEQ ID NO: 5831

SEQ ID NO: 5880 - RNA, 82 nt, Homo Sapiens; identical to SEQ ID NO: 5831

SEQ ID NO: 5881 - RNA, 82 nt, Homo Sapiens; identical to SEQ ID NO: 5831

SEQ ID NO: 5882 - RNA, 82 nt, Homo Sapiens; identical to SEQ ID NO: 5831

SEQ ID NO: 5883 - RNA, 82 nt, Homo Sapiens; identical to SEQ ID NO: 5831

SEQ ID NO: 5884 - RNA, 82 nt, Homo Sapiens; identical to SEQ ID NO: 5831

SEQ ID NO: 5885 - RNA, 82 nt, Homo Sapiens; identical to SEQ ID NO: 5831

SEQ ID NO: 5886 - RNA, 82 nt, Homo Sapiens; identical to SEQ ID NO: 5831

SEQ ID NO: 5887 - RNA, 82 nt, Homo Sapiens; identical to SEQ ID NO: 5831

SEQ ID NO: 5888 - RNA, 82 nt, Homo Sapiens; identical to SEQ ID NO: 5831

SEQ ID NO: 5889 - RNA, 82 nt, Homo Sapiens; identical to SEQ ID NO: 5831

SEQ ID NO: 5890 - RNA, 82 nt, Homo Sapiens; identical to SEQ ID NO: 5831

SEQ ID NO: 5891 - RNA, 82 nt, Homo Sapiens; identical to SEQ ID NO: 5831

SEQ ID NO: 5892 - RNA, 82 nt, Homo Sapiens; identical to SEQ ID NO: 5831

SEQ ID NO: 5893 - RNA, 82 nt, Homo Sapiens; identical to SEQ ID NO: 5831

SEQ ID NO: 5894 - RNA, 82 nt, Homo Sapiens; identical to SEQ ID NO: 5831

SEQ ID NO: 5895 - RNA, 82 nt, Homo Sapiens; identical to SEQ ID NO: 5831

SEQ ID NO: 5896 - RNA, 82 nt, Homo Sapiens; identical to SEQ ID NO: 5831

SEQ ID NO: 5897 - RNA, 82 nt, Homo Sapiens; identical to SEQ ID NO: 5831

SEQ ID NO: 5898 - RNA, 82 nt, Homo Sapiens; identical to SEQ ID NO: 5831

SEQ ID NO: 5899 - RNA, 82 nt, Homo Sapiens; identical to SEQ ID NO: 5831

SEQ ID NO: 5900 - RNA, 82 nt, Homo Sapiens; identical to SEQ ID NO: 5831

SEQ ID NO: 5901 - RNA, 82 nt, Homo Sapiens; identical to SEQ ID NO: 5831

SEQ ID NO: 5902 - RNA, 82 nt, Homo Sapiens; identical to SEQ ID NO: 5831

SEQ ID NO: 5903 - RNA, 82 nt, Homo Sapiens; identical to SEQ ID NO: 5831

SEQ ID NO: 5904 - RNA, 82 nt, Homo Sapiens; identical to SEQ ID NO: 5831

SEQ ID NO: 5905 - RNA, 82 nt, Homo Sapiens; identical to SEQ ID NO: 5831

SEQ ID NO: 5906 - RNA, 82 nt, Homo Sapiens; identical to SEQ ID NO: 5831

SEQ ID NO: 5907 - RNA, 82 nt, Homo Sapiens; identical to SEQ ID NO: 5831

SEQ ID NO: 5908 - RNA, 82 nt, Homo Sapiens; identical to SEQ ID NO: 5831

SEQ ID NO: 5909 - RNA, 82 nt, Homo Sapiens; identical to SEQ ID NO: 5831

SEQ ID NO: 5910 - RNA, 82 nt, Homo Sapiens; identical to SEQ ID NO: 5831

SEQ ID NO: 5911 - RNA, 82 nt, Homo Sapiens; identical to SEQ ID NO: 5831

SEQ ID NO: 5912 - RNA, 82 nt, Homo Sapiens; identical to SEQ ID NO: 5831

SEQ ID NO: 5913 - RNA, 82 nt, Homo Sapiens; identical to SEQ ID NO: 5831

SEQ ID NO: 5914 - RNA, 82 nt, Homo Sapiens; identical to SEQ ID NO: 5831

SEQ ID NO: 5915 - RNA, 82 nt, Homo Sapiens; identical to SEQ ID NO: 5831

SEQ ID NO: 5916 - RNA, 82 nt, Homo Sapiens; identical to SEQ ID NO: 5831

SEQ ID NO: 5917 - RNA, 82 nt, Homo Sapiens; identical to SEQ ID NO: 5831

SEQ ID NO: 5918 - RNA, 82 nt, Homo Sapiens; identical to SEQ ID NO: 5831

SEQ ID NO: 5919 - RNA, 82 nt, Homo Sapiens; identical to SEQ ID NO: 5831

SEQ ID NO: 5920 - RNA, 82 nt, Homo Sapiens; identical to SEQ ID NO: 5831

SEQ ID NO: 5921 - RNA, 82 nt, Homo Sapiens; identical to SEQ ID NO: 5831

SEQ ID NO: 5922 - RNA, 82 nt, Homo Sapiens; identical to SEQ ID NO: 5831

SEQ ID NO: 5923 - RNA, 82 nt, Homo Sapiens; identical to SEQ ID NO: 5831

SEQ ID NO: 5924 - RNA, 82 nt, Homo Sapiens; identical to SEQ ID NO: 5831

SEQ ID NO: 5925 - RNA, 82 nt, Homo Sapiens; identical to SEQ ID NO: 5831

SEQ ID NO: 5926 - RNA, 82 nt, Homo Sapiens; identical to SEQ ID NO: 5831

SEQ ID NO: 5927 - RNA, 82 nt, Homo Sapiens; identical to SEQ ID NO: 5831

SEQ ID NO: 5928 - RNA, 82 nt, Homo Sapiens; identical to SEQ ID NO: 5831

SEQ ID NO: 5929 - RNA, 82 nt, Homo Sapiens; identical to SEQ ID NO: 5831

SEQ ID NO: 5930 - RNA, 82 nt, Homo Sapiens; identical to SEQ ID NO: 5831

SEQ ID NO: 5931 - RNA, 82 nt, Homo Sapiens; identical to SEQ ID NO: 5831

SEQ ID NO: 5932 - RNA, 82 nt, Homo Sapiens; identical to SEQ ID NO: 5831

SEQ ID NO: 5933 - RNA, 82 nt, Homo Sapiens; identical to SEQ ID NO: 5831

SEQ ID NO: 5934 - RNA, 82 nt, Homo Sapiens; identical to SEQ ID NO: 5831

SEQ ID NO: 5935 - RNA, 82 nt, Homo Sapiens; identical to SEQ ID NO: 5831

SEQ ID NO: 5936 - RNA, 82 nt, Homo Sapiens; identical to SEQ ID NO: 5831

SEQ ID NO: 5937 - RNA, 82 nt, Homo Sapiens; identical to SEQ ID NO: 5831

SEQ ID NO: 5938 - RNA, 82 nt, Homo Sapiens; identical to SEQ ID NO: 5831

SEQ ID NO: 5939 - RNA, 82 nt, Homo Sapiens; identical to SEQ ID NO: 5831

SEQ ID NO: 5940 - RNA, 82 nt, Homo Sapiens; identical to SEQ ID NO: 5831

SEQ ID NO: 5941 - RNA, 82 nt, Homo Sapiens; identical to SEQ ID NO: 5831

SEQ ID NO: 5942 - RNA, 82 nt, Homo Sapiens; identical to SEQ ID NO: 5831

SEQ ID NO: 5943 - RNA, 82 nt, Homo Sapiens; identical to SEQ ID NO: 5831

SEQ ID NO: 5944 - RNA, 82 nt, Homo Sapiens; identical to SEQ ID NO: 5831

SEQ ID NO: 5945 - RNA, 74 nt, Homo Sapiens
aguuuugcaccugagacagauagccucacucgccucacccuaguccugguggcauuugucucaggugcaaaauu

SEQ ID NO: 5946 - RNA, 101 nt, Homo Sapiens
auaagcugcucuaauugccaagaauucacaugugguuguaugcagcuuuacugggagacugaaguguaucugcaugugauucugcugugauggacacuugu

SEQ ID NO: 5947 - RNA, 101 nt, Homo Sapiens; identical to SEQ ID NO: 5946

SEQ ID NO: 5948 - RNA, 109 nt, Homo Sapiens
auaagcugcucuaauugccaagaauucacaugugguuguaugcagcuuuacugggagacugaaguguaucugcaugugauucugcugugauggacacuuguaaguuugu

SEQ ID NO: 5949 - RNA, 109 nt, Homo Sapiens; identical to SEQ ID NO: 5948

SEQ ID NO: 5950 - RNA, 63 nt, Homo Sapiens
auacuuacuagcauauuauauagcucuaagaguguagaguuauaugaugugcuagugaagugu

SEQ ID NO: 5951 - RNA, 89 nt, Homo Sapiens
auagaaaucauuauugucuaggcuuuuggagaagcauaugcugugaaaaugaucacggcugugcuccuaaaagccagucauguuucugu

SEQ ID NO: 5952 - RNA, 100 nt, Homo Sapiens
auagacaggucucacucuguugcccaggcuggagugcaguggugugacuguagcucacuauagccaccaaguccugggcucaagcgauccuccugucuau

SEQ ID NO: 5953 - RNA, 107 nt, Homo Sapiens
auaugcugaguugggacaggagcuaaggauagaggugaggaaacccgcagacaacagcgacaugcuccucaucuuugagucccagcgaaccuuuccacugugugugu

SEQ ID NO: 5954 - RNA, 69 nt, Homo Sapiens
aucaaucacacugggugaccuuuacucccugucaggucaguaagagucacccaguguaaacagcaugau

SEQ ID NO: 5955 - RNA, 97 nt, Homo Sapiens
aucaguggcauauuagauucucauaggaaugugaaccguguugugaccaugcgagggaucuagguugcaugcucuucaugagaaucuaauaucugau

SEQ ID NO: 5956 - RNA, 106 nt, Homo Sapiens
aucaucaggcauuagauucucauaaggagcacacaaccuagauugcuagcaggcacaguucacaauaggguucguucuccugugagaauggcaugccgcugcugau

SEQ ID NO: 5957 - RNA, 75 nt, Homo Sapiens
auccugggaaggacccuacccagucauuuuaucuaccccaaccaugguuaaaguggcuggaguggagucuuggau

SEQ ID NO: 5958 - RNA, 78 nt, Homo Sapiens
aucgucugagcccaggaguuugaggcugcagugagcuacaaucacaccccugcacucaagccuggguuacagagugau

SEQ ID NO: 5959 - RNA, 80 nt, Homo Sapiens
aucugcauguuuuguugucucuguguuguacaguggaggagaaacaaugcauuuuggggacagcuaggacccaugcagau

SEQ ID NO: 5960 - RNA, 76 nt, Homo Sapiens
aucugucuuuccaagccuuccccgggaucagaguuuuuaaggauaauuugguggggagaggcuugggaaguggggu

SEQ ID NO: 5961 - RNA, 87 nt, Homo Sapiens
aucuuguacauuuuccccacacuuggaaucagccauuccuccagggagugcagguucacaggcugggcucuaagagaauuauaaggu

SEQ ID NO: 5962 - RNA, 110 nt, Homo Sapiens
augaagugagucacauuggcuacuggugaggaaggagcagaguugugggcugagacugaugcuguucagcaucugucuuccuugucaccaacauagaugaccacuagcau

SEQ ID NO: 5963 - RNA, 68 nt, Homo Sapiens
augaauccguuuuuaugaaauguccaaaauaggcaaaucuauggacagaaaguagaaagcagauucgu

SEQ ID NO: 5964 - RNA, 79 nt, Homo Sapiens
augacagcaagacacuggcccuggaauccuccgugucacaugugggcugcugacaggaagaaugugcuuuuguuguugu

SEQ ID NO: 5965 - RNA, 96 nt, Homo Sapiens
augacugugcugcaggaggcggcucagugugaagaacuacggguuuccugauguugaagcucagaauuagccacacugaccuucucagucaugcau

SEQ ID NO: 5966 - RNA, 83 nt, Homo Sapiens
augaguauugaucugucccagccugugcauugcuccgaggcaguucugaguggaugauguacagaugggauuccucagcucau

SEQ ID NO: 5967 - RNA, 92 nt, Homo Sapiens
augaguccacagccucgggggacgauuguuccuguuucuguagaauugauuugaaacuugaauaaugucccacugggaggcaaggugaucau

SEQ ID NO: 5968 - RNA, 91 nt, Homo Sapiens
augaugccaggacugcagcuucagggacuuguggcagaugcacagggugccucuggcucccuggagcuccacacugcagucccagcucugu

SEQ ID NO: 5969 - RNA, 131 nt, Homo Sapiens
augcauggggguacacaggggacacaaugcaguguuggugggaaauagucauugagcacuucuccuuuccucucaugugaaauguucagagaaucaccaccagacacucccgugugaaaauuuguaugcau

SEQ ID NO: 5970 - RNA, 113 nt, Homo Sapiens
augccuaauuuagcacauaguuccuguccccaaaaucuaauaaacucagaaguaauaaauuuucuggguuuuuguggguuugcccucugagcuaggguaguuaaaaguugcau

SEQ ID NO: 5971 - RNA, 93 nt, Homo Sapiens
augcucaaguauacugaugucaccaggcagaauucagauaauggugaccagagauccugucugagcaaccuggugacauuagauaccagacau

SEQ ID NO: 5972 - RNA, 101 nt, Homo Sapiens
auggcaugcacguguuggaaguuaguggaggcuaucuccccaguggucaaaggaggucuugcuggagaaauuauauuuuacuaacuugaagcagcagcugu

SEQ ID NO: 5973 - RNA, 78 nt, Homo Sapiens
auggcgugaacccgggaggcggagcuugcagugagccgagaucgagccacugcacuccagccugggcaacagagcgau

SEQ ID NO: 5974 - RNA, 87 nt, Homo Sapiens
auggguagcaugaacuaagguagauaaaggcuucacgugguguuuggcauggcguagguguagauuggaccucaguuuucugcccau

SEQ ID NO: 5975 - RNA, 78 nt, Homo Sapiens
auguccaaagacucaacaguuagacuacuuuucuuccacucauuuuaaagaaaaaugucuaugaaguguuuuggauau

SEQ ID NO: 5976 - RNA, 73 nt, Homo Sapiens
auguuaugauuguuucauuuguuggaaauaaggaaaacuugcaugguuugaauuguggaacaauagguggugu

SEQ ID NO: 5977 - RNA, 95 nt, Homo Sapiens
auguucugaaguacugaggguuagggcuucaacuuacgaauuuggugaguucacaguucagccuguaacacauuucuucaggauuuccagagcgu

SEQ ID NO: 5978 - RNA, 108 nt, Homo Sapiens
auuacuagguuuaaauaagaacagaugcuugcuuugguucaaguuaggcaugccucugaugcauuucuuaauaccaaggcaaaucucugagggcuuagacuuaguagu

SEQ ID NO: 5979 - RNA, 86 nt, Homo Sapiens
auuaugugcuguaguauguauauaguauuuuuagugaaaauauucauauaaaauauuacuuaaaucauuucuacauugcacaaaau

SEQ ID NO: 5980 - RNA, 93 nt, Homo Sapiens
auuauucugaugaaaauccacaaugucuuugagcuucugguuguguaaugcugggguuuaaagucaccauuuguggguuuggcaucaauuaau

SEQ ID NO: 5981 - RNA, 125 nt, Homo Sapiens
auuguauugcagcagguuggcagccucaguaaaucuccauuuguaaaugugacagucagcagaaucuccaguuacagucaacucaaagcaagcaggggcaugccacauacauguucauauauagu

SEQ ID NO: 5982 - RNA, 74 nt, Homo Sapiens
auuuccugcugccagcuuaauacucaccagggcagauucacaccaaguugggguuucaguggcagucaggaagu

SEQ ID NO: 5983 - RNA, 79 nt, Homo Sapiens
caaagagguguagaaucuggguugguccuucaaggcagcucauugcagcuacuggccuccagugaaacaggucucuuug

SEQ ID NO: 5984 - RNA, 106 nt, Homo Sapiens
caaaucaguggcauauuagauucucauaggaaugugaaccguguugugaccaugcgagggaucuagguugcaugcucuucaugagaaucuaauaucugaugaucug

SEQ ID NO: 5985 - RNA, 71 nt, Homo Sapiens
caaauuuggugugcuuucuccuuugccugcugcuucuuucaaguaggacauggagacaacagccaaauuug

SEQ ID NO: 5986 - RNA, 98 nt, Homo Sapiens
caacaggugcaaguguuaaaggguaugauccuucaguggaacaaagccuccgugucaccugagggauagcaacaugccuacaagcacugcaagaguug

SEQ ID NO: 5987 - RNA, 101 nt, Homo Sapiens
caacccaguaaguguccccagucaaugcuucucuccauaggagaccuguaaaugggcgguggggggaggaauuuucuggucucacacacuauuauggguug

SEQ ID NO: 5988 - RNA, 88 nt, Homo Sapiens
caagcagugaagggugcagaucauggauagagcuuucaagaaguuuguucuaguucuucuccugaaacuggaccucccuccuagcuug

SEQ ID NO: 5989 - RNA, 92 nt, Homo Sapiens
caaguugugaccuucccaguccucucuccauuugcagaucagcaagcuucugucagcaaggagggguggacaaugaaacuggguucagcuug

SEQ ID NO: 5990 - RNA, 96 nt, Homo Sapiens
caaguuuggucaaggggugaguguguccgacuccaaggagcaucuccguuucugagugggaacucucaugacacugugucccuugccucaggcuug

SEQ ID NO: 5991 - RNA, 101 nt, Homo Sapiens
caaugggggacauuugccaagaguugagaaugcuguaauuggaggccugagaggugggucccaauucuuacauuuuccauuccacaaacugucuccuuuug

SEQ ID NO: 5992 - RNA, 72 nt, Homo Sapiens
cacaauccucagcguguuaacugaagccuuguugaguuuaacaaagcugccauugaagaucuggggaaagug

SEQ ID NO: 5993 - RNA, 87 nt, Homo Sapiens
cacagccaguuucuuugaugacucaaaacguacuuugugaucuugccaagcuuugagaucaucguuacaagcagcauuuugguugug

SEQ ID NO: 5994 - RNA, 84 nt, Homo Sapiens
caccccguucauguaacacgggccugaggucagcaguagaggaccaguauugguuuuggccccagccucugcguggauggauug

SEQ ID NO: 5995 - RNA, 96 nt, Homo Sapiens
cacccgugccugggauucucuaagacaaaggagaagucuuaaagccuuacagcgucuuaagucuuagaucacauuuagagagacccgguacaggug

SEQ ID NO: 5996 - RNA, 106 nt, Homo Sapiens
caccugccuauauuacauucauuuugaugguuuguaucucaaaggaguacagugaacgaaacuuguuuaaagauacaccggaaagaaaaagagaagaggcagagug

SEQ ID NO: 5997 - RNA, 90 nt, Homo Sapiens
caccugucaugccaguuacuuggggggcuaaggugggaggauuagugagcugugauucugccacugcauuccagccugggugacagagug

SEQ ID NO: 5998 - RNA, 100 nt, Homo Sapiens
cacgagcaguuugugucacagauggccggaagagacucuuuugccugguuacaggcauguuuuucugccauccuguugaauuuucccaucaacuccuuug

SEQ ID NO: 5999 - RNA, 102 nt, Homo Sapiens
cacgcgucuuuguggucaccuggcuuaggaagcucacaagguccucaucauuuggagguguuucccugugagugcccucagcccuaggcuuucuuacgugug

SEQ ID NO: 6000 - RNA, 81 nt, Homo Sapiens
cacggcuauuaaguagcagaacugggcuugaauucagaucugcuucucaguccaguguucucugcucuguaacuggcugug

SEQ ID NO: 6001 - RNA, 106 nt, Homo Sapiens
cacuaggcuagacauacaaagaccccuugcccguggcucccauuucaaauauaucucaugaccagggugugggagcacgacagaggagguaagaguuuaaacugug

SEQ ID NO: 6002 - RNA, 98 nt, Homo Sapiens
cacucccugagugaagguguguguguuaggaaaugugcuuacugggugaacacaacagagguguuccccaccucaugauacccacagucuagggagug

SEQ ID NO: 6003 - RNA, 84 nt, Homo Sapiens
cacucuguaauaaagaacuuggaaagggagguuccaagauggccaaauaugaacagcuccagucuacagcccccagcgugagug

SEQ ID NO: 6004 - RNA, 76 nt, Homo Sapiens
cacugccaacugaggcaggagggcucaggagagucuucgccucuuguacccuccuugggccucuccaaaaccagug

SEQ ID NO: 6005 - RNA, 97 nt, Homo Sapiens
cacuguagggcaguaaggaaagaauguucuuuuucaaaaauagucugagccaauuggauguuuuuguggaauauuuuuuuaauuugcccugcaugug

SEQ ID NO: 6006 - RNA, 75 nt, Homo Sapiens
cacugugugauuugauuccaagcuacccaugaagaaacccagacucagaggucacuugccuagggucacacagug

SEQ ID NO: 6007 - RNA, 73 nt, Homo Sapiens
cacuugaaccuggaaggcagggguugcagugagcugagauugugccauugcacuccagccugggcaacaagug

SEQ ID NO: 6008 - RNA, 96 nt, Homo Sapiens
cacuuucaugucugccuucuuugcuggaaggugccucccuauuccacagacuuuggaucagugggugugggggaauccaaggcagaccaugaaaug

SEQ ID NO: 6009 - RNA, 111 nt, Homo Sapiens
cagaagggguuuuuaucaaaaauauguagauucuacuacaauauuuuagcuaaagaagaagaaguaguaguagcaguaguagucaguauuuuugacccugacccaacucug

SEQ ID NO: 6010 - RNA, 70 nt, Homo Sapiens
cagaauguuugcaucuauucacaugugcaucagcagugcauuuguaguuaaauguguaguuaacguucug

SEQ ID NO: 6011 - RNA, 112 nt, Homo Sapiens
cagacccucucucuuucccaggcuuccuguccuucagcaaggccaccugagaacugaauuguaaauuccagccuugcaaggaaggggaggaggcugaaagacaagauaaaug

SEQ ID NO: 6012 - RNA, 91 nt, Homo Sapiens
cagagucucgcucuguugcucaggcuggagugcaguggugcaaucuuggcucacugcaaccuccaucuccuggguuuaagcgauucucaug

SEQ ID NO: 6013 - RNA, 84 nt, Homo Sapiens
cagauaaccagacacaccccugggcugggcacacaguuccuuauuuggguuuugugguuuucccaggugguagcugggacucug

SEQ ID NO: 6014 - RNA, 92 nt, Homo Sapiens
cagaugccuccuucgggagccacaggauccagagagucaaugaaaguaaaacuucaggacugucuggauuuauuacgccagggaggaaguug

SEQ ID NO: 6015 - RNA, 108 nt, Homo Sapiens
cagauugcacgaacauuucauuuuucacacagggucaccagaauaccaucaauuuuuugguaucacugucaaaagugauccuagcaccuucugaaauaacgugagcug

SEQ ID NO: 6016 - RNA, 110 nt, Homo Sapiens
cagccucaagugauccaccaccucagcuucccaaagugcugggauuacaggcaugauccaccacgccuggucccauuguucuuuacaucugaugggcugcuuuuggguug

SEQ ID NO: 6017 - RNA, 130 nt, Homo Sapiens
cagcgcggcucccgccacccucaauaaauguugcuuggaguggaccgaggcucugcaggaaugcagggagggccgggcuccgccccaggguuauuucuaaguugaggacaggagguugugaguucugcug

SEQ ID NO: 6018 - RNA, 130 nt, Homo Sapiens; identical to SEQ ID NO: 6017

SEQ ID NO: 6019 - RNA, 130 nt, Homo Sapiens; identical to SEQ ID NO: 6017

SEQ ID NO: 6020 - RNA, 111 nt, Homo Sapiens
cagcugggacugcaggggcacaacaucacgccuggcuaauuuuuguauuuucuguagggcuaggauuucacaguguuacccaggcuggucucaaaauccugggcucaaaug

SEQ ID NO: 6021 - RNA, 80 nt, Homo Sapiens
cagcuugcagcacacacagcauuggucaugaggucagcugcucucugacccacuugcucagaguuguuugcugccuguug

SEQ ID NO: 6022 - RNA, 80 nt, Homo Sapiens; identical to SEQ ID NO: 6021

SEQ ID NO: 6023 - RNA, 98 nt, Homo Sapiens
caggcaaagguggcuuaaugaagagcaagggguuuuuagaugacauggugguaguguuauuaauaaacucuuuuuccucuuuaugcagcugguuccug

SEQ ID NO: 6024 - RNA, 130 nt, Homo Sapiens
caggcagcaggaugaucucuuguggaguaaaaugucagguguuuuuuuuuuuaagaaaucgauuuuuaguugugacgucauuuggcaggcuguccacgguaucacuuucugcuuauuuuuaaaaggucug

SEQ ID NO: 6025 - RNA, 94 nt, Homo Sapiens
caggcugguucgucguuucugccucuccauucuugucuuuuuaauucuuuguguuauuugagauggaguuugagagggaauaugaacaagccug

SEQ ID NO: 6026 - RNA, 90 nt, Homo Sapiens
cagggagaagagcugugugcugugaugugguuuauaaauuaccauuuggaaggagcugcacagcacagcagccugcaacuacucuuccug

SEQ ID NO: 6027 - RNA, 120 nt, Homo Sapiens
cagguacuccaugugauauaugguuccacaauccucagcguguuaacugaagccuuguugaguuuaacaaagcugccauugaagaucuggggaaagugaagaaguugcaacagaguuuug

SEQ ID NO: 6028 - RNA, 79 nt, Homo Sapiens
cagguaugacaugugccacugugucugaaauuccugagcaccgagggccgcuucaggcaccaggcacuuugccaaccug

SEQ ID NO: 6029 - RNA, 97 nt, Homo Sapiens
caggugugcgccaccacacgugacugggaagccuucugguuuuaagauggcuuuagaaugaaaggcaguuccuagcaccuguggucaaucacaucug

SEQ ID NO: 6030 - RNA, 89 nt, Homo Sapiens
cagguguggacuaccaugccuggcuaauuuuuguauuuuugguagaaacaggguuuuaccauguuggccaggcuggucuugaacuucug

SEQ ID NO: 6031 - RNA, 92 nt, Homo Sapiens
caguaaacauaaguuccucaggagaguuugaugugugucaggugcuuagaacagggccugauauauaaucagcccaugaugagcuauuacug

SEQ ID NO: 6032 - RNA, 76 nt, Homo Sapiens
cagugggaaggggggccgauacacuguacgagagugaguagcaggucucacagugaaccggucucuuucccuacug

SEQ ID NO: 6033 - RNA, 101 nt, Homo Sapiens
cauaaugaguccacagccucgggggacgauuguuccuguuucuguagaauugauuugaaacuugaauaaugucccacugggaggcaaggugaucauaaaug

SEQ ID NO: 6034 - RNA, 68 nt, Homo Sapiens
cauagcugucuggaggcgcaguuuucagaaaccauagacaucugagaaauauguuucuggcuuuuaug

SEQ ID NO: 6035 - RNA, 66 nt, Homo Sapiens
cauauaugucugguauucuuggggucuaguagucuaguauaauacacauagccuaggacauguaug

SEQ ID NO: 6036 - RNA, 130 nt, Homo Sapiens
caucaaagaauaaauaagcugcucuaauugccaagaauucacaugugguuguaugcagcauuacugggaaauugaaguguaucugcaugugauucugcugugauggacacuuguaaguuuguuccuggag

SEQ ID NO: 6037 - RNA, 131 nt, Homo Sapiens
caucacccagugguucucucagcaacagacauguccaguggaccguaguguugugacggucgcccaucugcgcccaguaccucggaucaugcggaacauguugucaaagcugcagauugccugugacaacg

SEQ ID NO: 6038 - RNA, 79 nt, Homo Sapiens
caucagcuauuccuguucuagaaagggcacucuggcugcaauguggaggagggagugacuggaggaagggagguaagug

SEQ ID NO: 6039 - RNA, 60 nt, Homo Sapiens
caugaaauuuagugugauuauuuuuucuacuuuuuaaucaucauuauuuugaaguuuaug

SEQ ID NO: 6040 - RNA, 130 nt, Homo Sapiens
cauggggucgugucacugggcuccucagggaaggcaguagguuguauaguuaucuuccgaggggcaacaucacugcccugaaaccacacaaccuacuaccucaccccgccaggcccggccuugcacugcg

SEQ ID NO: 6041 - RNA, 94 nt, Homo Sapiens
cauguuggccagacuggucuguaacuccagacuucaggugaucugcccaccuuggccucccaaagugcugggauuacaggccugagccaccaug

SEQ ID NO: 6042 - RNA, 131 nt, Homo Sapiens
cauuaaaacucaccaucaaauagauguaaucuuauuaauuacacauuuuguauuuuaauuauuucaaggagugaagaaaacaggguguuuuuguuuuuguaguucugauuacucauuuaugcauuguuuug

SEQ ID NO: 6043 - RNA, 86 nt, Homo Sapiens
cauuagauucucauaagagcccaaacccuauugugagcugcacaugcaagggaucuagguugugcgcuccuuaugagaaucuaaug

SEQ ID NO: 6044 - RNA, 117 nt, Homo Sapiens
cauuuuaguaaugcucagcuggaccaguguuaguuauauuugagucagaaaaauguuguuuuucaacuugcuuuauaaucuccugcaucuaucuccugcuguagcaucacgaaggug

SEQ ID NO: 6045 - RNA, 93 nt, Homo Sapiens
ccaaguagaagcaaacuguaguuugaugcuagaacacuauucuuugagaggguaugugugauacucgaaaugcagucauggcucacggcuugg

SEQ ID NO: 6046 - RNA, 110 nt, Homo Sapiens
ccaauccccaaccccugcagugcuuugauuaugagaaaguucugcaugacuuagcauaacugcucuuuucuaaaagccucugcaauuagauccaaaggguugggguuugg

SEQ ID NO: 6047 - RNA, 120 nt, Homo Sapiens
ccacaccagaggcugugaccauggcuaguagacaguggcaacauagucauccccaagaugcuaaucuucugcuggaacugucauacguuaucauggucaauguaaaccugguuugugugg

SEQ ID NO: 6048 - RNA, 94 nt, Homo Sapiens
ccacagugggggugcccgggcugggucccacuggggaagcucaaggcagcccuggccuuucccucauucuccacccagucaggccccugcgugg

SEQ ID NO: 6049 - RNA, 90 nt, Homo Sapiens
ccacguggauuacugggcuccucucaguguggaagcugauuuccaacaaggagcauucaaagauuaggaguucccaguguucauaagugg

SEQ ID NO: 6050 - RNA, 80 nt, Homo Sapiens
ccagagagucucuccagguacgccacacagucuuugagcugugucagagcuggauuguuuaccuggggcuggcuguuugg

SEQ ID NO: 6051 - RNA, 106 nt, Homo Sapiens
ccagaggcugugaccauggcuaguagacaguggcaacauagucauccccaagaugcuaaucuucugcuggaacugucauacguuaucauggucaauguaaaccugg

SEQ ID NO: 6052 - RNA, 111 nt, Homo Sapiens
ccagcugccacccuucuacccaaccccaucucauagaacucacaacaaccuuguugggagaaaaggaggggauacaggggcuuaaagagggggaaauaaccauauagcugg

SEQ ID NO: 6053 - RNA, 97 nt, Homo Sapiens
ccaggccugaccugucucuugaaggaguauuuguguugaagaugggugguaacguucagcaaaagccaugcccaggagacaggcacaguacccaugg

SEQ ID NO: 6054 - RNA, 111 nt, Homo Sapiens
ccaggccugccgguagguuuagaaugaggucugugucacugugguauuacgauauuuugacugguuauuauaaccacagugucacagaguccaucaaaaacccaugccugg

SEQ ID NO: 6055 - RNA, 89 nt, Homo Sapiens
ccagggaaaguaguaaguuguauaguuaucuucuaauuggggccuaauaucccuaccccacaacaauacaacuuacuaccucacccugg

SEQ ID NO: 6056 - RNA, 93 nt, Homo Sapiens
ccaguauauuucugcagucugguauguuuuucccccuaagaaccucagcugagaaauaaagcagguuaacaaagcuguaugaaaugucacugg

SEQ ID NO: 6057 - RNA, 102 nt, Homo Sapiens
ccaguauuguguggggaguguuuugaggucaucuaaugguguugucuauucuucaguagcaacuccaacacccucuacauuugcuaucaccacacaaccugg

SEQ ID NO: 6058 - RNA, 75 nt, Homo Sapiens
ccaguucuccuuuaguguucaggcucaaaugaaaggccacuuucagcaaguuuuccugacauugucggagacugg

SEQ ID NO: 6059 - RNA, 95 nt, Homo Sapiens
ccaucucugcuuauuccucugccacgucuuucccuucuccucucugcucucauaaagaagaaugggagaugaaaguggaggggcagcugaggugg

SEQ ID NO: 6060 - RNA, 107 nt, Homo Sapiens
ccaucuggcagaacacugggcaaaagagguucugauucuggccuguuacuugcuguacaaacuugcacaaggccagagaggacucucuuuucccaucugcaaagugg

SEQ ID NO: 6061 - RNA, 100 nt, Homo Sapiens
ccaucuucaguggcauugggccuuggcugggaugcugaguuauccacuggagcaucggcaguacaggcaggcacagaggcaguggauccaucggaggugg

SEQ ID NO: 6062 - RNA, 108 nt, Homo Sapiens
ccaugcuaaauaaaggagagcuuagguagacagacuugaccuuggagaggccagagaagccuucucugaggacagaaaguuugugcugaagucugaaguguaaguagg

SEQ ID NO: 6063 - RNA, 77 nt, Homo Sapiens
ccauguuaauuuccugguagugaugacagcacugugauuauauaggaguguguccuugguguuugggaauuacaugg

SEQ ID NO: 6064 - RNA, 118 nt, Homo Sapiens
ccauuuuuuuguaggucagaagugguugcaaacuggauuuuuagacucuuccuguugggggucucggacauuugcucuuuuccacagcggccaauucuucagagccacaaagaacugg

SEQ ID NO: 6065 - RNA, 86 nt, Homo Sapiens
cccaaagcucacaguuuggcacugaaucauauacaaucucguaguuuggauggcugugugugacugcagacugcuagacagcaggg

SEQ ID NO: 6066 - RNA, 98 nt, Homo Sapiens
cccaaccccugcagugcuuugauuaugagaaaguucugcaugacuuagcauaacugcucuuuucuaaaagccucugcaauuagauccaaaggguuggg

SEQ ID NO: 6067 - RNA, 94 nt, Homo Sapiens
cccaagguuacuugguaaguaaagagagaagccagaagccuggggccuccugacggcuccugcuucucuuuuuacuaaggucuucugccauggg

SEQ ID NO: 6068 - RNA, 81 nt, Homo Sapiens
cccacagguaagaaccuuguguuuuccagauucugaguguggcucagcucgugaaugcaguggcacaaggcacucuguggg

SEQ ID NO: 6069 - RNA, 74 nt, Homo Sapiens
cccacaggugauucuguugugcagccaugguuggcaggcuguucacggugcuguucaacagguccugcuguggg

SEQ ID NO: 6070 - RNA, 100 nt, Homo Sapiens
cccagaacaaagaccucuagccaacauguaagcaccuagaccaugguuucccauccuuaucauuguuaacauuuuggcuagauaguucuuuguugugugg

SEQ ID NO: 6071 - RNA, 87 nt, Homo Sapiens
cccagacagugcccguuuugagaugugaccugguggccaccaaaugccuuggccucagugcaaacuaagcagggcacacugccuggg

SEQ ID NO: 6072 - RNA, 102 nt, Homo Sapiens
cccagcaugauucauaccuguaaucuuacccauucuugauuuagaugagauuuggauuucgaguugaugcuagaauggguuaauacuuuugaggauguuggg

SEQ ID NO: 6073 - RNA, 84 nt, Homo Sapiens
cccagcccaagauugaauucugauuaaaggaggcugaauugcagagccuccuuucaucaaauucgaguuuugaauugagcuggg

SEQ ID NO: 6074 - RNA, 104 nt, Homo Sapiens
cccagguuucaguuugguagcaugaauccuuagcauuuagugacuccaguuuuggucugcugucuuucuuaaauggaugcaugaggcaaccauuggguacuggg

SEQ ID NO: 6075 - RNA, 102 nt, Homo Sapiens
cccagugacccacagguaagaaccuuguguuuuccagauucugaguguggcucagcucgugaaugcaguggcacaaggcacucugugggaguggaucuuggg

SEQ ID NO: 6076 - RNA, 84 nt, Homo Sapiens
ccccaccccaguggagcucaccuuccaguaggucuaaacugguuugauugaguuccauggaaaacaacaaagugggguaagggg

SEQ ID NO: 6077 - RNA, 75 nt, Homo Sapiens
ccccagcccggaagccuccacuaucuccagcccagacaaacccugugguccagaggaggaaugagggugcagggg

SEQ ID NO: 6078 - RNA, 110 nt, Homo Sapiens
ccccgagggugugacugagagccaguccccagcacccuuguccagauggggaccaggaggugggugaagauauuuggggucugagcucugugcugguugcccccgagggg

SEQ ID NO: 6079 - RNA, 115 nt, Homo Sapiens
cccgaccacuagcagccucuuucagucacuggaaaaugcuuacaggcaguagccaccaucauguggcacaaagugggcaucauccuagugucuaacauuuaagcugugguucugg

SEQ ID NO: 6080 - RNA, 102 nt, Homo Sapiens
cccgccucagccucucgagucacugggauuacagaugugagccaccaugcccaguuggaugcucuaaacauuaaauucuaagcaaagagaugaugaggcugg

SEQ ID NO: 6081 - RNA, 103 nt, Homo Sapiens
cccgccucagccucucgagucacugggauuacagaugugagccaccaugcccaguuggaugcucuaaacauuaaauucuaagcaaagagaugaugaggcuggg

SEQ ID NO: 6082 - RNA, 108 nt, Homo Sapiens
cccggaguuuauggucuggugagaagaucccugcucugagucacugccaagcucuagcuaugugacuuugaacagggaauuucugucccuaucuauaaaauaaacggg

SEQ ID NO: 6083 - RNA, 110 nt, Homo Sapiens
cccuaaaagugacugaauugcccaagugcuugaacauggcagagguaguuacuccuauuuugcaguuugugcacuuaaaaauuccuacagugauuguuacuuuacugggg

SEQ ID NO: 6084 - RNA, 95 nt, Homo Sapiens
cccuacuauuuucuugggaaacauccagcacauacucaaggugggagggcaguaagcuugaugguggcuagauguuucugaagacaagaguaggg

SEQ ID NO: 6085 - RNA, 81 nt, Homo Sapiens
cccucagcacagguuuuggcucuuagaauggguuuuuuaaaaaaaggaucuuucuuaauuccaggacuccugaguuggggg

SEQ ID NO: 6086 - RNA, 113 nt, Homo Sapiens
cccugaacucaggggcuucgccacugauuguccaaacgcaauucuuguacgagucugcggccaaccgagaauuguggcuggacaucuguggcugagcuccgggcgcaacaggg

SEQ ID NO: 6087 - RNA, 92 nt, Homo Sapiens
cccugccgcaggagagccacuuucagagaugcccugagugaucgucaccagcugcauccugcaaacuucaucuugcugucccuguggcuugg

SEQ ID NO: 6088 - RNA, 77 nt, Homo Sapiens
cccuggaggcaggugcagauggaggcuguuuccugucaggaugugggacuuugucuucuucugacaguuccccaggg

SEQ ID NO: 6089 - RNA, 77 nt, Homo Sapiens; identical to SEQ ID NO: 6088

SEQ ID NO: 6090 - RNA, 72 nt, Homo Sapiens
cccuggcugaggugggaucccgaggccucuccaguccccugagggugcaccacuggcccaucucacccaggg

SEQ ID NO: 6091 - RNA, 79 nt, Homo Sapiens
cccugucagagcucuccagaauaugcuuguuggagauccuucaggcaguaagggagaguuuugccuccuuacacagugg

SEQ ID NO: 6092 - RNA, 89 nt, Homo Sapiens
cccuguccugucuucgaguauuuguuuuuaaugcugggugucgaucgagacaacaagcgcucagagcaaagcaaggaugcauuacgggg

SEQ ID NO: 6093 - RNA, 110 nt, Homo Sapiens
cccuuaugggauucuggaagugguggcuacacggauguacaugagugugaaaaaaucauuaaacuguaugcucugugaagcuuacuguaucuguuauccuuccuaauggg

SEQ ID NO: 6094 - RNA, 72 nt, Homo Sapiens
cccuucagucucaguagccacauuucaagugcucaauaguuacaugugcccaguggcugcuggacugggugg

SEQ ID NO: 6095 - RNA, 80 nt, Homo Sapiens
cccuuucaaaacaaagcuuucccaggauagcccugggcagaacuccugggauugacugggcaguaauguaguugagaggg

SEQ ID NO: 6096 - RNA, 101 nt, Homo Sapiens
ccgaggcuacgugaaggaacacuuugccuggagacauuucuacugguaccuuaccaaugaggguauccaguaucuccgugauuaccuucaucugcccccgg

SEQ ID NO: 6097 - RNA, 121 nt, Homo Sapiens
ccgaugaacccagggccguucccuucauacccuuucauuaguagcucuaagauguuugauuaagguguacguuuacagaggaguugguuggugaugagcauugaacauuuggguucuucgg

SEQ ID NO: 6098 - RNA, 96 nt, Homo Sapiens
ccgcagggagaagagcugugugcugugaugugguuuauaaauuaccauuuggaaggagcugcacagcacagcagccugcaacuacucuuccugagg

SEQ ID NO: 6099 - RNA, 102 nt, Homo Sapiens
ccgguagguuuagaaugaggucugugucacugugguauuacgauauuuugacugguuauuauaaccacagugucacagaguccaucaaaaacccaugccugg

SEQ ID NO: 6100 - RNA, 95 nt, Homo Sapiens
ccgucacagcacuugcccucaauguucaucacugaagacaagcaugugauuuucucaucacauccucccacuucaaguggggcagggcagugagg

SEQ ID NO: 6101 - RNA, 95 nt, Homo Sapiens
ccguggcccguguucucuccuuuuguccccauagugugacuccgccaggaacuuggaauggcugaagacugugaaugagagucaugggucugugg

SEQ ID NO: 6102 - RNA, 78 nt, Homo Sapiens
ccuaaaacauaagugaagaucaggcuacagugcuuuucucaugacauggagccuuguuguuuguucacucauucuagg

SEQ ID NO: 6103 - RNA, 91 nt, Homo Sapiens
ccuaacaguuguuuucugaguauauuuucaugucaaauagcaaaaguagaacuuuuggaggaggugugaagaaaugaagagugacuagagg

SEQ ID NO: 6104 - RNA, 112 nt, Homo Sapiens
ccuacauguguuacacucaguguguaaauaacugugaagaggcaauugucagauagcaaauugggcaccugcuguguacgguauauugcacuggggcugacggguguguagg

SEQ ID NO: 6105 - RNA, 79 nt, Homo Sapiens
ccuaccaugacuguucucaaaguuugaaguugagcauaccgaugcgccacuccugcuucaaugcuugagaagucguagg

SEQ ID NO: 6106 - RNA, 112 nt, Homo Sapiens
ccuagaugggaucugcugcaggcaagauauucccggccucagaagcugaggggagaaccuucuguucuuccccaccuucggcuugcauuccuccuucagcaucuucuuaagg

SEQ ID NO: 6107 - RNA, 89 nt, Homo Sapiens
ccuaucacagaccugccagauuccucugguaaacugcagguucccucugccucaguuguggccagggauucugaccaggagaugauggg

SEQ ID NO: 6108 - RNA, 108 nt, Homo Sapiens
ccucagcagacaucagaaaauucaugcucggaagaaugccuacaggaaugaaaacuuaauaauugugggaaauacuugagcaaaauaucugguuucaugguauguagg

SEQ ID NO: 6109 - RNA, 90 nt, Homo Sapiens
ccucagccucccaaagugcugggauuacaggugugaaccaccaugcccggcagugauucauuucuaaacccagcuuguuaaaaggugagg

SEQ ID NO: 6110 - RNA, 80 nt, Homo Sapiens
ccucaucucuacaaaaaauacgaaaauuagcugggugugguggcauguaccuguagucccagcuauuugagagacugagg

SEQ ID NO: 6111 - RNA, 90 nt, Homo Sapiens
ccucauugguucauucggcagcuguuuauuuagaaccugccgugugcuagggcagaucugggauacagcuguggacaagggaggaugagg

SEQ ID NO: 6112 - RNA, 94 nt, Homo Sapiens
ccuccuccauccgucucccagggugccuuuguuuugaaucauuuuugauuucaauuuaagaagagaaagaagaggcugagacgaaggaaggagg

SEQ ID NO: 6113 - RNA, 83 nt, Homo Sapiens
ccuccugcugaagcuucuggauuugagaggcuuuacucuccaggagagugaagcgaguugggccagagcugagagucuggugg

SEQ ID NO: 6114 - RNA, 88 nt, Homo Sapiens
ccuccugugucccaaaacgaaaacacuccuauauuuuguagcgccuuccagaauggggcagcggaaacuaguguugggacaaaggagg

SEQ ID NO: 6115 - RNA, 69 nt, Homo Sapiens
ccugaacccaggaggcggaggcugcagugggccaagauuaagccacugcacuccagccugggcaacagg

SEQ ID NO: 6116 - RNA, 80 nt, Homo Sapiens
ccugacucugaucacaggcaaaggaauaaagucucauuucaauccugagcuucuccuaauucuuguggaucagagcuggg

SEQ ID NO: 6117 - RNA, 105 nt, Homo Sapiens
ccugagacagaguuugcucuuguugcccaggcuggaguuuaauggcacgaucuuggcuuaccacaaccucugccuccuggguucaagcaauucuccugccucagg

SEQ ID NO: 6118 - RNA, 120 nt, Homo Sapiens
ccugcccaccaacucccaggcuuauucaccaaccacuccaccagcucugacccugacuucugggguucccaucucaguccucagccugugcugcugcccccugaagagcauccuuccagg

SEQ ID NO: 6119 - RNA, 75 nt, Homo Sapiens
ccugcuguaugcuaggcauugugcaagguguuagggcugaugcuugagcacaguaccuccacaucugcaguaugg

SEQ ID NO: 6120 - RNA, 75 nt, Homo Sapiens; identical to SEQ ID NO: 6119

SEQ ID NO: 6121 - RNA, 108 nt, Homo Sapiens
ccuggaggccuuuccauauuagauauguccccuucuauaagugcaauacacuuaaugguucccucugugcuuagggagggaaguaaucuaagcagaagguuuuuaagg

SEQ ID NO: 6122 - RNA, 75 nt, Homo Sapiens
ccuggucuuuaagagugauuggaggcugggcaugguggcuuaugccuguaaucccagcacuuugggaggccaagg

SEQ ID NO: 6123 - RNA, 86 nt, Homo Sapiens
ccuguacaaagcagccuuggaccaggagggaaaaccccaaggcucugcagccucccugcuccccuccguuuaaggcuguggucagg

SEQ ID NO: 6124 - RNA, 84 nt, Homo Sapiens
ccuguccucaguaaagaacuuggaguauguuguuccucaaauaucuuuugaugaaugggugcuccaggaguuucuacugacagg

SEQ ID NO: 6125 - RNA, 89 nt, Homo Sapiens
ccuuagguuuuaucaauccuggugcccuuccauuguaucacauccuuggaucacagugauggguucaggaauagacacaugacccaagg

SEQ ID NO: 6126 - RNA, 108 nt, Homo Sapiens
ccuucaaaaaguuuguagccuaucgggguggagagauaagccaaguauccagauaaccauggcauaaggcagaauauuuucuguacuaugagagguacaaaggggagg

SEQ ID NO: 6127 - RNA, 109 nt, Homo Sapiens
ccuucaaaaaguuuguagccuaucgggguggagagauaagccaaguauccagauaaccauggcauaaggcagaauauuuucuguacuaugagagguacaaaggggaggg

SEQ ID NO: 6128 - RNA, 103 nt, Homo Sapiens
ccuuggcauucauuauuuucauuccaguucucagcacagcgcuuggcacauaguaggaacucaggaaguguuuaugggauggaauggggugaugauguugagg

SEQ ID NO: 6129 - RNA, 96 nt, Homo Sapiens
ccuuggcccugugaggcuucaccucuugagccugagaagcagaggugacaguacuggcccugguucuuagcagggggguggcgggcaggguagggg

SEQ ID NO: 6130 - RNA, 101 nt, Homo Sapiens
ccuugggggcuuaaugauucagcguggaaugaguuuuguuguuaggguggacagaaaaacccuauggcaaagucacugauuucccugagugugcccuuugg

SEQ ID NO: 6131 - RNA, 112 nt, Homo Sapiens
ccuuugaacaguggaacuggaugaaagaaaugggaucugugcagcuacuucaguuagcuggaauccuacaguucugguuucuucuuuaaugcuaguuuucccuuuucagagg

SEQ ID NO: 6132 - RNA, 74 nt, Homo Sapiens
ccuuugaacccuguguuaacaaugagaagcuuguuuauuugaaggcuggguucucauuggcccacagggguagg

SEQ ID NO: 6133 - RNA, 106 nt, Homo Sapiens
ccuuugcuuuggccuuuaacaacucaguguuuuggucuaaucuucaagaggaauuugagguucacuugaauaaguuagacuaguuugagguggguguagcuagagg

SEQ ID NO: 6134 - RNA, 97 nt, Homo Sapiens
cgaaccagguagaaguaaugugugccaggacaagagacgcacccagagccucuggccuuggucuccuauccuggcucacaagcacacuccaaguuug

SEQ ID NO: 6135 - RNA, 92 nt, Homo Sapiens
cgaaggcagcauggaagaauaggcaguauuggauuugaaaucaggagacuuggaauugaauucugccucuuccacuaccagcugugaaauug

SEQ ID NO: 6136 - RNA, 81 nt, Homo Sapiens
cgaauggaccacuggagggguucaaagauuccaguucuaauaugggaaugagccucuuugaucucuuccggggcuuuuucg

SEQ ID NO: 6137 - RNA, 131 nt, Homo Sapiens
cgagugauuuuugagguaaguauguuauuggaaaggugugaucuauauagaacccuguacaugaaaaggaggagaugccgcuaucuuggcagggaugaucauguauuugaaauaguaacucacagcauuug

SEQ ID NO: 6138 - RNA, 86 nt, Homo Sapiens
cgcacaucuguuacuccacaucagagacuucauuuuguugauaaacccuaugaauguaaggaaugugggaaggcguucagagugcg

SEQ ID NO: 6139 - RNA, 74 nt, Homo Sapiens
cgcucuuucacccaggcuggagugcaguggcaugaucucagcucacugcaaccuccaucuccuggguucaagcg

SEQ ID NO: 6140 - RNA, 76 nt, Homo Sapiens
cgcugccucucugcaggccgugugcuuugcucgguugaucuugcagagccuaagacacaggcccagagaggcagug

SEQ ID NO: 6141 - RNA, 72 nt, Homo Sapiens
cgcuugagcccaggaggcagagguugcagugagccaagauggcaccacugcacuccagccugggcaacagug

SEQ ID NO: 6142 - RNA, 74 nt, Homo Sapiens
cgcuugagcccaggaguucgaggcugcagugagcugugaucacaccacugcacuccagccugggcaacagagcg

SEQ ID NO: 6143 - RNA, 75 nt, Homo Sapiens
cgcuugcaacugaaaggcggagguugcagugaaccaagaucgcaccacugcacuccagccugggcaacaaaagcg

SEQ ID NO: 6144 - RNA, 91 nt, Homo Sapiens
cggacccugcugugagcagcucccuauuccaugacaguguguugagcucuccauugucagaggcugguaggguguucagcuagaggugccg

SEQ ID NO: 6145 - RNA, 96 nt, Homo Sapiens
cggggauucagucugugaggcgggaagcccacuaggaggacucucacuuugcugagucucucuuucccuucuuucuucuucacccaauaaacccug

SEQ ID NO: 6146 - RNA, 86 nt, Homo Sapiens
cgggugaggaaguguuauugucagggucucccuuucagaaggccuuggggccaaggggaggagcuggaauugccuuccaccgcgug

SEQ ID NO: 6147 - RNA, 112 nt, Homo Sapiens
cggugagauggcugaaagguagacaucgagaaguuuuaauauucagaaucuuuucuucucaagacgcugaauguaaucuuaguuguaaauacccaucaccugccagucaccg

SEQ ID NO: 6148 - RNA, 84 nt, Homo Sapiens
cgucacggaaugcuguccugaucccuagcauuuacucacaugcugugcuuagugcuugaccaugugguggcagauucugugaug

SEQ ID NO: 6149 - RNA, 105 nt, Homo Sapiens
cgucuaggugaaaugagcuguguaguccuuuagagccucuggacagaagguaaugcucuuaauccagugauucucgagggcagaauggaggauuugcacuagaug

SEQ ID NO: 6150 - RNA, 131 nt, Homo Sapiens
cuacucuggaggcugaggcaggagaaucgcuuuaacccgggaggcagagguuguggugagccgagaucgcgccauugcacuccagccugggcaacaagagcggaauucugucucaaaaaaaaaaaagagag

SEQ ID NO: 6151 - RNA, 95 nt, Homo Sapiens
cuacuguuguggcuuuugcaaauuacuaaauuucucugugacuacuuuuccauuucuuaaguaauuugguugguuuccaaaagucaauaaugugg

SEQ ID NO: 6152 - RNA, 95 nt, Homo Sapiens
cuagagucccccucagcugugggggagcuuucaaauuugaaaucaggagacucgaauuccaguuuuuccuaccccuuagugcugugggacuuuag

SEQ ID NO: 6153 - RNA, 73 nt, Homo Sapiens
cuagcugcugccagccaagcugcuaccagaccagcuccugcggaacuggcuguggcauuggugguggcauugg

SEQ ID NO: 6154 - RNA, 99 nt, Homo Sapiens
cuagggugcacaguuuuuaagaaggcucgcucucucagggggaccaucccgcacuugcaugcccuugagaaugagguccuccuuaaauauucacucugg

SEQ ID NO: 6155 - RNA, 100 nt, Homo Sapiens
cuaugcccagcauuggaaagaguagaggcccuuacuagcacaccucaaaucaaacugggguugcagcagaccuuuugccuucuuuagaggcuggaaauag

SEQ ID NO: 6156 - RNA, 93 nt, Homo Sapiens
cucacccguucuacuggcaacuggaguuuguucaagaaauaccugaguugguucuuuaacugucgaguucgauuguccaaguggaaggguggg

SEQ ID NO: 6157 - RNA, 74 nt, Homo Sapiens
cucagacucaccaaacagucugcuucuuaccccaguguaagcacugaacaggcagguggguguaugggucugag

SEQ ID NO: 6158 - RNA, 73 nt, Homo Sapiens
cucagagggcuuggucaccucugccaugaggcuggacugcagcugugguggcaagugaccagaugucacugag

SEQ ID NO: 6159 - RNA, 112 nt, Homo Sapiens
cucagccucucccugauguaaucuggguuccuuguguggcaacaguaaugggaagaaaggaccugaaauauuaguugauuccaagggacccucuaagguuagagaggcagag

SEQ ID NO: 6160 - RNA, 121 nt, Homo Sapiens
cucaggaggcugaggcaggaggaucacuugagccugggaggucuaggcugcagugagccgggacgaugccacugcacuccagccugggcaacagagugagacccugucccagcacucuggg

SEQ ID NO: 6161 - RNA, 96 nt, Homo Sapiens
cucaggggcuucgccacugauuguccaaacgcaauucuuguacgagucugcggccaaccgagaauuguggcuggacaucuguggcugagcuccggg

SEQ ID NO: 6162 - RNA, 78 nt, Homo Sapiens
cucagguccuuuagugcuucucagucaacagacagggagggagcuuccccugugacugaggugcgcauaaagacugag

SEQ ID NO: 6163 - RNA, 106 nt, Homo Sapiens
cucauggucuccaaaggucucuacccagacauuucaacuuuguuguucuuuggcuacaaagaacaggagaaauggaggacuucugugggaguguggagacagugag

SEQ ID NO: 6164 - RNA, 97 nt, Homo Sapiens
cucccagcgucacggaaugcuguccugaucccuagcauuuacucacaugcugugcuuagugcuugaccaugugguggcagauucugugauguguaag

SEQ ID NO: 6165 - RNA, 69 nt, Homo Sapiens
cucccaggcaauauuccaggauaggcugccaguuggacuaaggaagccacuccugcggaacccugggag

SEQ ID NO: 6166 - RNA, 107 nt, Homo Sapiens
cucccccgagaaugucagccccuugaagcugcggucugucuaugcuggucguacccucagagccuaagaugacacagagcucaggaaaugaacacccucggaggggg

SEQ ID NO: 6167 - RNA, 99 nt, Homo Sapiens
cuccuguaguccuagagcguuucucuugaacccuaauuuuuaggucucaaagagugggcuucagagauaaagagguuuaggcagggacagggcgaggag

SEQ ID NO: 6168 - RNA, 99 nt, Homo Sapiens; identical to SEQ ID NO: 6167

SEQ ID NO: 6169 - RNA, 94 nt, Homo Sapiens
cuccuuagguuuuaucaauccuggugcccuuccauuguaucacauccuuggaucacagugauggguucaggaauagacacaugacccaagggag

SEQ ID NO: 6170 - RNA, 82 nt, Homo Sapiens
cucgugcugcgacaguuccauuccuaaugcagacuuacaaaaacuagguguaaggcuggcauuagggugaggccaggaugag

SEQ ID NO: 6171 - RNA, 116 nt, Homo Sapiens
cucguggcugcugcugcuccugcucucccucucccuccuccaggccacggauuucaugucccugugacugguggggcccauggaggagacaggaagccucaaguuccagugcagag

SEQ ID NO: 6172 - RNA, 103 nt, Homo Sapiens
cucucaccccucuagccuuaaauccagaaucuagacugaauauggacugaaugggucagauuuggggaaauguguuucuggggacagcugagggaccagagag

SEQ ID NO: 6173 - RNA, 116 nt, Homo Sapiens
cucucaucauagauuaaucacuuaguugcaagggaccaguaaauuaacagaauggugaacauuuuccuuuucuuggugcuuuugcuggaugacuagugguuucugcuggaacagag

SEQ ID NO: 6174 - RNA, 81 nt, Homo Sapiens
cucucaugcaggcaugugugagcagcugcaggugugugagcaaaugugcaucacuggggaacaggugucuguggaugaggg

SEQ ID NO: 6175 - RNA, 111 nt, Homo Sapiens
cucucuuuggcuacagacuuaccucaggcuggcuggagaguaaaucaggucuaaaagagucuccuucauaacaggcugaggauacucccagcaaucugaagccggagagag

SEQ ID NO: 6176 - RNA, 83 nt, Homo Sapiens
cucuggcacuuccaaucuccuaccugugauagacgucuaagugaaaguacuagcuuaguuguuugggauugguagugacagag

SEQ ID NO: 6177 - RNA, 114 nt, Homo Sapiens
cucuguaguuaugugcggucuuacacuauuuuacauggucacuaucagcuuaguuguuugucacuuguuggugacugcuguaagguagauuugagauguccagggacugcagag

SEQ ID NO: 6178 - RNA, 100 nt, Homo Sapiens
cucugucacccaggcuggagugagugugaucuuggcucacggcaaccuuugccuccuggguucaagcaauucuccugcccuagccucccgaguagcagag

SEQ ID NO: 6179 - RNA, 131 nt, Homo Sapiens
cucugugaugcuuggggaccggcuccucggucacaccccaguccugcucugaagguugccguuuuccaaacagaaggaugguagcuagaggggagauagcaagauucuggagucuggaaagccuucacuug

SEQ ID NO: 6180 - RNA, 72 nt, Homo Sapiens
cucuuaaacccgggaggcggagguugcagugagccgagauugcgucacugcacuccagccugggcaacagag

SEQ ID NO: 6181 - RNA, 89 nt, Homo Sapiens
cucuuaaaccuuuagaaaugcuacagcaucuagcuucucuagaucaauaaucacagaggcuuaagugcugaccucauaaagauaaagag

SEQ ID NO: 6182 - RNA, 73 nt, Homo Sapiens
cucuugaacccaggaaguggagguugcagugagcugagauagcaacacugcacuccagccugggcaacaagag

SEQ ID NO: 6183 - RNA, 73 nt, Homo Sapiens
cucuugaacccaggagguggagguuggggugagcugagaucacuccauugcacuccagucugggcaacgagag

SEQ ID NO: 6184 - RNA, 85 nt, Homo Sapiens
cucuugaccagagggucucaaaugagggacauuuuaccugccaggggacauuuccaauguuuggggacacuuuugguuaucagag

SEQ ID NO: 6185 - RNA, 82 nt, Homo Sapiens
cucuugaccagagguucucaaaugagggacauuuuaccugccggggacauuuccaauguuuggggacacuuuugguuaucag

SEQ ID NO: 6186 - RNA, 82 nt, Homo Sapiens; identical to SEQ ID NO: 6185

SEQ ID NO: 6187 - RNA, 82 nt, Homo Sapiens; identical to SEQ ID NO: 6185

SEQ ID NO: 6188 - RNA, 97 nt, Homo Sapiens
cucuugcccaggcuggaguucagugguaugaucacaacucuccuaagccucaaacaccugggaucaagugauccucuggcuucagccucccaaguag

SEQ ID NO: 6189 - RNA, 78 nt, Homo Sapiens
cucuuugaggucuguuguucagaaaaauuucuuggaaaauaugauuguucauggacaacggaccucaucacccaagag

SEQ ID NO: 6190 - RNA, 94 nt, Homo Sapiens
cucuuuugcaaaacaaaagaugucuucuuuucccuuagcccuugguuuuguuuggcagaugguguaggugaagagaacauuaguuguggaagag

SEQ ID NO: 6191 - RNA, 102 nt, Homo Sapiens
cugaaagucuaucugcugccacgccugggcacauacugcaucauuuacaaaacuguagagcaccuguugugugugcaguugugauuucuuauagauuuuuag

SEQ ID NO: 6192 - RNA, 116 nt, Homo Sapiens
cugaaggguggagagggccucucaugcaggcaugugugagcagcugcaggugugugagcaaaugugcaucacuggggaacaggugucuguggaugagggaggaagugagggugagg

SEQ ID NO: 6193 - RNA, 92 nt, Homo Sapiens
cugaaucaugcaguguauacaggaugucagugaagaggucuggcaggaaugccucacucucuuccuacugacugguacauguuaugaugcag

SEQ ID NO: 6194 - RNA, 72 nt, Homo Sapiens
cugaaugaccugcagucagggcccagaguugggacucuauacuacccugggcucuggucuguagguuuguag

SEQ ID NO: 6195 - RNA, 85 nt, Homo Sapiens
cugacaugugcauuauccaugucauuuuaaacaaagugaccuauggaaggguacgcugugcugugacaugguaaugggcuguugg

SEQ ID NO: 6196 - RNA, 78 nt, Homo Sapiens
cugagaggcagaggcuucagugagccgaggccacaccacugcacuccggccuuggugacagagacucugccucgaaag

SEQ ID NO: 6197 - RNA, 128 nt, Homo Sapiens
cugagaggugagauuccacaucccaaguugcacagcuggggagagacagugucaggacaguaucgccugugcugaggucuagcuccccagcuagacugaagcuuuaugaggauuuuauucauuucaag

SEQ ID NO: 6198 - RNA, 103 nt, Homo Sapiens
cugagcagggagaaucucgggaucccaggaggucaaggcugcagugagccacaauuuugccacugcacuccagccugggcaacagagcaagacccugucucag

SEQ ID NO: 6199 - RNA, 100 nt, Homo Sapiens
cugagcuuagaucuuauguggccuuucuggucuguguaucccaggacuguucaucuccuaugugaugcugaagaccaagagagugaccaagaaggcucag

SEQ ID NO: 6200 - RNA, 107 nt, Homo Sapiens
cugagcuuagcuaucuuugugguucaauucaccggagucucaaaaccuggcagguguuaucaucuuccugaggcaccgagagucgggacugccagaggccugcacag

SEQ ID NO: 6201 - RNA, 96 nt, Homo Sapiens
cugaggcaccuccacuggccccuuugugaggcacgcuugaccuggguuucauggaaagaaugugcccucaccaaagggugcuaaacaaggccccag

SEQ ID NO: 6202 - RNA, 101 nt, Homo Sapiens
cugaggcagagaaucucuugaaccugggagguggagguugcagugagccgagauuguccacugcacuccagccugggcaacagaguaagacucugucucag

SEQ ID NO: 6203 - RNA, 105 nt, Homo Sapiens
cugaggcaggagaaauugcuugaacccaggagguagagguugcagugagucaagaucaugccauugcacuccaaccugggcgacaagagcaaaacucugucucag

SEQ ID NO: 6204 - RNA, 104 nt, Homo Sapiens
cugaggcaggagaaucacuugaaccugggaaauggagguugcagugagccaagauugagccacugcacuccagccugggcaacaagagugaaacucugucucag

SEQ ID NO: 6205 - RNA, 103 nt, Homo Sapiens
cugaggcaggagaauggcaugaacccaggagguggagcuugcagugagccgagaucacgccacugcacuccagccugggcaacacagcgagacuccgucucag

SEQ ID NO: 6206 - RNA, 103 nt, Homo Sapiens
cugaggcaggagaauugcuuguacccgggaggugaagguugcagugagccgagauggugccacugcacuccagccugggcaacagagcaaggcccuguuucag

SEQ ID NO: 6207 - RNA, 101 nt, Homo Sapiens
cugaguuuccauagggaacuauuggguuuaaagucaccguuggaacuacacugugugaucuuauaaacuuauguucccuggcuaucauauucuuggcucag

SEQ ID NO: 6208 - RNA, 91 nt, Homo Sapiens
cugcaaugcuguuuacuuauaggaugaaacuguaucagacuuuguaguggcugugcauguugauauccuggccaguaggcagugcgugcag

SEQ ID NO: 6209 - RNA, 117 nt, Homo Sapiens
cugcagcccaagcaaaauggaaauacaagcaaucauguaguucacuguguccaucagacaggaacaaaucagaugaccaggaauugagagacugaacauuuccucagguggcuggag

SEQ ID NO: 6210 - RNA, 98 nt, Homo Sapiens
cugcagcuccaauaaaauugccgagaugauguuuggguuugugcuggacauuccugagaggagccagaggugagucuugauuuuguuggggagagcag

SEQ ID NO: 6211 - RNA, 77 nt, Homo Sapiens
cugcagggcugcugccucaacauuuuagguucugauagcuguauucucaguccuggagugacagguguagccugcag

SEQ ID NO: 6212 - RNA, 78 nt, Homo Sapiens
cugcaguggugauguguugucacuucaggacaccccacuaccugaauugcagcaguguugcgaaucaucacucugcag

SEQ ID NO: 6213 - RNA, 91 nt, Homo Sapiens
cugcaucaccugugagaggaaagaaccuuguuuuuauagcagagaaauauaagcacagggagguucugucacuugccagugaugaucccag

SEQ ID NO: 6214 - RNA, 103 nt, Homo Sapiens
cugccagccgucugucucuaguguuuuuccaaaugacauccagggcucuggccguggagucccugaugugaucgcuaaaggaccuccggagaggggcucgcag

SEQ ID NO: 6215 - RNA, 100 nt, Homo Sapiens
cugcccccgcccucuggacccgagugacucaggccuuuguuuguccuuccugguagaggcggguucccucccucggcaagaugccggagugcugggaugg

SEQ ID NO: 6216 - RNA, 96 nt, Homo Sapiens
cugccuaaugaugguguauggaagcuguagcauuucuggcaccugccaacuugucagagcugccuuucccuuccuggcacuuugucuauguggcag

SEQ ID NO: 6217 - RNA, 81 nt, Homo Sapiens
cugccuagcuuagugagggaauccauucuggcuucagaccagucuggguuugaaaccuacacaucccacuaacuuaggcag

SEQ ID NO: 6218 - RNA, 99 nt, Homo Sapiens
cugccuauauuacauucauuuugaugguuuguaucucaaaggaguacagugaacgaaacuuguuuaaagauacaccggaaagaaaaagagaagaggcag

SEQ ID NO: 6219 - RNA, 102 nt, Homo Sapiens
cugccuccccacucaagcucuguaaggacgcaaagagggcaaggccacgaaggacucagccuggcccaucgugucccugcucugccccagugccagagccag

SEQ ID NO: 6220 - RNA, 72 nt, Homo Sapiens
cugccucucugcaggccgugugcuuugcucgguugaucuugcagagccuaagacacaggcccagagaggcag

SEQ ID NO: 6221 - RNA, 71 nt, Homo Sapiens
cugcuugaacccaggaggcagagauugcagugagucaagauggcacuacugcacuccagccugggcaacag

SEQ ID NO: 6222 - RNA, 68 nt, Homo Sapiens
cuggaacccaggaggaggagguuguggugagccaagaucgugccacugcacuccagccugggcaacag

SEQ ID NO: 6223 - RNA, 109 nt, Homo Sapiens
cuggaggauuuggggugccccucucggcagggaacaggaaguaggaaucccagaagggucugggggaacccuaacccugagcucaguccaguucaccccucaccuccag

SEQ ID NO: 6224 - RNA, 96 nt, Homo Sapiens
cuggaggcagcaaagauuaucuuauuuauuuuauuuuguuuucugcuauauuuagaguggcaaaaaaauagagcagaggguuucugcugucuccag

SEQ ID NO: 6225 - RNA, 73 nt, Homo Sapiens
cuggaggcucaggagucuuuuaucugcaauaggacaaugauucuccuagcagaucugugacuccuaugcucag

SEQ ID NO: 6226 - RNA, 106 nt, Homo Sapiens
cuggauuccccaaagcucacaguuuggcacugaaucauauacaaucucguaguuuggauggcugugugugacugcagacugcuagacagcagggcccacaucacag

SEQ ID NO: 6227 - RNA, 111 nt, Homo Sapiens
cuggcauacaagagcccggaacuucugccgauuugucacugcaaucaacaauacuccccggaacaucggcaaggauggcaaguuucagaugcuggugugcuugggagccag

SEQ ID NO: 6228 - RNA, 80 nt, Homo Sapiens
cuggcugcuccucuccauguacccauuccccuuggggugcaagccacaccacccuucacuugggggaugauagcagccag

SEQ ID NO: 6229 - RNA, 82 nt, Homo Sapiens
cugggaggcagagguugcagugaucaggaauugugccacugcacuccaaccugagugacagagcaacacucugucuuaaaag

SEQ ID NO: 6230 - RNA, 84 nt, Homo Sapiens
cugggaugggauggagcaagaggugaagaucuuggagucuggaaucagaccaccuggauuuucauccuaguuccccgaucuggg

SEQ ID NO: 6231 - RNA, 105 nt, Homo Sapiens
cugggauuacaggcaccugcugccaagucuggcuaauuuuuguauuuuuaauagagacgggguuucgcuauguuggccaggcuggucucgaacuccugaucucag

SEQ ID NO: 6232 - RNA, 85 nt, Homo Sapiens
cugggauuacaugugugagccaccgcgccuggccucaaauuguuuuugaaguaguuagguuguagcucauaagacugucuuucag

SEQ ID NO: 6233 - RNA, 93 nt, Homo Sapiens
cugggggcugagaccacccuugccugcccccuucuuucugccuuaagaauguccuuuuaggcugggcaugguggcucacgccuguaaccccag

SEQ ID NO: 6234 - RNA, 74 nt, Homo Sapiens
cuggguucccaaauucuccuugcuguucugcaucauugucuagauggauuaguaaagaagaaugaaaacuccag

SEQ ID NO: 6235 - RNA, 108 nt, Homo Sapiens
cuggucuggcagcacuaagaggcaggcauucuggguaucagacauaaauccccucccaggaacuuuuguguccugacccagaggacuggcucuugagaaugagaacag

SEQ ID NO: 6236 - RNA, 109 nt, Homo Sapiens
cuguaauuccagcacuuugggaugccgaguugagaggaucacuugaagccgggaauuugaggcugcagugagcuaugaucaugccgguguacuucagucugggcaacag

SEQ ID NO: 6237 - RNA, 84 nt, Homo Sapiens
cuguacaaagcagccuuggaccaggagggaaaaccccaaggcucugcagccucccugcuccccuccguuuaaggcuguggucag

SEQ ID NO: 6238 - RNA, 98 nt, Homo Sapiens
cuguauuucaugcaauacaaaggaagauggcuguuugggguugccgugucucuuagcaauuaaggagauggcuacagccaagcagugugaagugacag

SEQ ID NO: 6239 - RNA, 96 nt, Homo Sapiens
cuguccuguagauacaugggggaugaucauaagugagcuuuuauaagcgcagaguauuaccuauaucaccgugaaaguguaucgcauacaggacag

SEQ ID NO: 6240 - RNA, 102 nt, Homo Sapiens
cugucucugggcccugucugaggcuucuuaagauguuguuacaauaaucuacuauguggagugucuggaggugucucuuacuucucuggcauuaagagacag

SEQ ID NO: 6241 - RNA, 78 nt, Homo Sapiens
cugucugggcaacaugcugaaaccccagcucuguaaacaauacaaaaauuagcugggcguggcggucugugccuacag

SEQ ID NO: 6242 - RNA, 109 nt, Homo Sapiens
cugugacuauuucgcugaaucuuugcaacucugagaggucaguacuuuuauuuuacccauuuuguaggugagaaaacugaggcucagaaaggguaacacagugacacag

SEQ ID NO: 6243 - RNA, 112 nt, Homo Sapiens
cugugaugguuguguucuauuauaaaguggcaccauuggagucuaagggugcuuguuugcccuuacacuaaauggucccaaguguuuaugugguucugacacugccguccag

SEQ ID NO: 6244 - RNA, 83 nt, Homo Sapiens
cugugcucuugauaacagaguguuugagggacaacuuucacauuugaguuuuuccaaaauuaaagguuguagaagagucacag

SEQ ID NO: 6245 - RNA, 85 nt, Homo Sapiens
cugugguugaaggaauggauggaagugugugagcuagauugcacagauagcaagcagaacauuucuggugaacuuggacacacag

SEQ ID NO: 6246 - RNA, 108 nt, Homo Sapiens
cuguugcccaggcuggagugcaguggcaccaucucagcucacuggagcgucugccuccagguucaagugauucuccugccucagcaucccaaguagcugggacuacag

SEQ ID NO: 6247 - RNA, 82 nt, Homo Sapiens
cuguuguuaaaaccugcuuccccacugcucagccugccaucagccauccagcugcagagcaguggagaguaggucucaccag

SEQ ID NO: 6248 - RNA, 114 nt, Homo Sapiens
cuguuuccuauaggugcugucagaucagguuccugauuggaguucucuuaucugcucugguuuggagggcugccccauucgggaaucuguuuuguuuugcucaaauacacucag

SEQ ID NO: 6249 - RNA, 85 nt, Homo Sapiens
cuuaaguuugcuugcaguguauguguguaugucugugugugcaugcacgcacaugugcacaugcagcagggagaguggaauuaag

SEQ ID NO: 6250 - RNA, 87 nt, Homo Sapiens
cuuaccccaguauccuauuaucucauaccuaaggcagugaugguuucucagaccucuuagauugagaagauguggcauggguguaag

SEQ ID NO: 6251 - RNA, 110 nt, Homo Sapiens
cuuacccuguauuucaugcaauacaaaggaagauggcuguuugggguugccgugucucuuagcaauuaaggagauggcuacagccaagcagugugaagugacagcaccag

SEQ ID NO: 6252 - RNA, 75 nt, Homo Sapiens
cuucaccaaguugucauuugagcacaguuugaggaguguaagacagucaugcggacuugagggguacaagggaag

SEQ ID NO: 6253 - RNA, 106 nt, Homo Sapiens
cuucaccugaacucacuggggcuucuccagggauauuaaccuggacuuuaagagucagagugagucccugggacuaguucagcccauccaggauucagacgggaag

SEQ ID NO: 6254 - RNA, 69 nt, Homo Sapiens
cuuccaugggcaggggccaugacagggagauaggccacaccuuucccagguggaaccugcagauggagg

SEQ ID NO: 6255 - RNA, 130 nt, Homo Sapiens
cuucucacuuucccuucacacacagucguguaguuuugcgcuugcuugauuaaucucuuggccucagucgguuuucuaccauauggaguugguucauucucucgaauggcuguguaguccaguguguggg

SEQ ID NO: 6256 - RNA, 92 nt, Homo Sapiens
cuucuugcaggcaguguuguuccugauugccccagucuaguuuaucgcaagggaauuucuuugcggggcagugagcucccuuuuggcagaag

SEQ ID NO: 6257 - RNA, 70 nt, Homo Sapiens
cuugaacccaggaagcggagguugcagugagcugagauugccucacugcacuccagccugggcaacagag

SEQ ID NO: 6258 - RNA, 69 nt, Homo Sapiens
cuugaacccaggagguggagauugcagugagccgagaccacgccacugcacuccagccugggcaacaag

SEQ ID NO: 6259 - RNA, 69 nt, Homo Sapiens
cuugaacccgggaagcagagguugcagugagccgacaucgugccacugcacuccagccugggcaacaag

SEQ ID NO: 6260 - RNA, 70 nt, Homo Sapiens
cuugaacccgggaaggcggagguugcagugagccgagaucgugccacugcacuccagccugggcaacaag

SEQ ID NO: 6261 - RNA, 69 nt, Homo Sapiens
cuugaacccgggagguggaggcugcagugaacccagacccugccacugcacuccagccugggcaacaag

SEQ ID NO: 6262 - RNA, 69 nt, Homo Sapiens
cuugaaccugaaaggcagaggcugcggugagcugagauugcgccauugcacuccagccugggcaacaag

SEQ ID NO: 6263 - RNA, 66 nt, Homo Sapiens
cuugaaccugggagguggaggcuacagugagcugagaucaugccacugcacuccagccugggcaag

SEQ ID NO: 6264 - RNA, 93 nt, Homo Sapiens
cuugacaccuccuguccaguacugucuugaugccugccccauaaagugacucugcgaugggcaaguguuaugaucagauuggaggguguaaag

SEQ ID NO: 6265 - RNA, 119 nt, Homo Sapiens
cuugagaaaagacaacuaguauuugaggaaggugugagaaaugagccuaaagagguagaugagacucaaaggaggcugauaaagauaccacagcuacaaguuuuuguuauauucugaag

SEQ ID NO: 6266 - RNA, 74 nt, Homo Sapiens
cuugaucugucacccaggcugcaguguaguggcaugaucucggcucacugcaacccccgccuccuggguucaag

SEQ ID NO: 6267 - RNA, 71 nt, Homo Sapiens
cuugccaugcagcccuuuuuauggagcaagucacaauacagcagcuugcuucauuagggcaagcaagcaag

SEQ ID NO: 6268 - RNA, 78 nt, Homo Sapiens
cuugcuugaacccaggaggcggagggugcagugagucgacaucaugccacugcacuccagccugggcaacagagcaag

SEQ ID NO: 6269 - RNA, 88 nt, Homo Sapiens
cuuggcuggguuuuuccacgugagauggugucauauugcuggguccagcacccaguuauuguggcccaauuuccuauacccugccuag

SEQ ID NO: 6270 - RNA, 90 nt, Homo Sapiens
cuuuaguuuuaaggaagugucucuuggcuggccccuagauagcuuuaggaugggagcuagucaccagaaacaccaauccuugauuagaag

SEQ ID NO: 6271 - RNA, 75 nt, Homo Sapiens
cuuucucucgugaauggagcuguuuucuucagagccuuugcucugaaacaucacgcuccccuguauggggagaag

SEQ ID NO: 6272 - RNA, 130 nt, Homo Sapiens
cuuucugugccacucaggaagcaaugggcaugauucagcagaggagaggagaguuuagaacugguuaugcuuccuucuccaacccucccugcaaaaacacuggccagcuccugacaucacaguaagacag

SEQ ID NO: 6273 - RNA, 106 nt, Homo Sapiens
cuuugagaugacugguauugaauggagcagucuuugaaaggcaccaacccuuccuaacugaugguggucucuugaaagaggcucuuccaaauuugucuucugaaag

SEQ ID NO: 6274 - RNA, 73 nt, Homo Sapiens
cuuugugaguggcuuugaaacuguaaugagcgcaguuuacugagucauuacuagucucgacccauucguagag

SEQ ID NO: 6275 - RNA, 71 nt, Homo Sapiens
cuuuuccaccaucuaagagaaaggaaguucagagccuuagcuucaacaccacaauuucuuaacuggaaaag

SEQ ID NO: 6276 - RNA, 131 nt, Homo Sapiens
cuuuugagcugcuucuuauaaugugucucuuguguuaaggugcaucuagugcaguuagugaagcagcuuagaaucuacugcccuaaaugccccuucuggcacaggcugccuaauauacagcauuuuaaaag

SEQ ID NO: 6277 - RNA, 112 nt, Homo Sapiens
cuuuuuccuccagugaacggugacuugacagagguacauaggaggcuacuuguucucuuguuggcugcuuguauuugcuuucuggaagguuauuguuuucaaggaucuuaag

SEQ ID NO: 6278 - RNA, 100 nt, Homo Sapiens
cuuuuucucugcccuucgucauuaugcagccugugaacagcgucugggaaagugguggucauugguugcauaauuugaucugaggcuuauggaggaaagg

SEQ ID NO: 6279 - RNA, 72 nt, Homo Sapiens
gaaaagggcugaucaguauuuucugauccuaguucagugcuagucagggagacugucaguaaagaccuuuuu

SEQ ID NO: 6280 - RNA, 60 nt, Homo Sapiens
gaaaagguggugucauguuuuggggagaaucuuacuucucaaauggaaauugcacuuuuu

SEQ ID NO: 6281 - RNA, 100 nt, Homo Sapiens
gaaagggaguccacggaagcgugagaauggaggaagaacagugcuuugagugacugcugcagggucuuccuauuauuuuuaguucugaggauucucguuc

SEQ ID NO: 6282 - RNA, 87 nt, Homo Sapiens
gaaagucuguuguuguaaacauccccgacuggaagcuguaagacacagcuaagcuuucagucagauguuugcugcuaccggcuauuc

SEQ ID NO: 6283 - RNA, 82 nt, Homo Sapiens
gaaauccugggguugcaagacugccagccugugugaucaauccugcgguuaggaagguggaguuuugcuuucccaucuuuuc

SEQ ID NO: 6284 - RNA, 99 nt, Homo Sapiens
gaaauggagucuugcuuugucaccgaggcuggagugcaguggcaugaucucugcucacugcaagcuccaccucccggguucacgccauucuccugccuc

SEQ ID NO: 6285 - RNA, 116 nt, Homo Sapiens
gaaauguggagaauuaaaaaggguagugaggcuggcauuuauagaaucuggcuuucuuguauuggguggaaagcuagaugaaaccaguuucucucagccuuuucucuccucagguc

SEQ ID NO: 6286 - RNA, 96 nt, Homo Sapiens
gaacacaaagagguguagaaucuggguugguccuucaaggcagcucauugcagcuacuggccuccagugaaacaggucucuuugagcuauuuguuc

SEQ ID NO: 6287 - RNA, 107 nt, Homo Sapiens
gaacauccaggucuggggcaugaaccuggcauacaauguagauuucuguguucguuaggcaacagcuacauugucugcuggguuucaggcuaccuggaaacauguuc

SEQ ID NO: 6288 - RNA, 86 nt, Homo Sapiens
gaaccuuugauguuacucuaucgucuggaucucuuuugccugugagggaggcagagagguauuuaggcaugaggcagcagagguuu

SEQ ID NO: 6289 - RNA, 106 nt, Homo Sapiens
gaacugggucauuuaucaaacucuguguuuauguggccuuuagaauauuaucccucaguaaguuagaggcacagauuaauggaguuugaagguugucacuugguuu

SEQ ID NO: 6290 - RNA, 96 nt, Homo Sapiens
gaagaacugggugaucuugugaaaucuguggacccuacauuggcacuuaguguguaccuaagggcuaacgucccaaauaaagucauucagugcuuu

SEQ ID NO: 6291 - RNA, 76 nt, Homo Sapiens
gaagaagaagaauggguuuggugagaggguuccaauauuaacaacccaacuucaagcucauuccucuaaccucuuc

SEQ ID NO: 6292 - RNA, 131 nt, Homo Sapiens
gaagaaguagauugggcugcaaucacacaaugggugcaucaccagugcggacaccuaggcguacagggaaccauggcuuggggaguguaaagaaggauguuaccccaggaugcaguucagacaauuuuauc

SEQ ID NO: 6293 - RNA, 90 nt, Homo Sapiens
gaagaaucgcuugaaucccaaagguggagguugcagugagccgagaucgcgccacugcacuccagccuggcgacagagcaagacuccguc

SEQ ID NO: 6294 - RNA, 93 nt, Homo Sapiens
gaagaaucucuuaaacccgggaggcggagguugcagugagccgagauugcgucacugcacuccagccugggcaacagagcgagacuccguuuc

SEQ ID NO: 6295 - RNA, 130 nt, Homo Sapiens
gaagaggccuuuacuccuguuuucuuccauucucaccccucuguuucugccagaauugugacagcagggcagaaaaugggcuuuucgugcagaguugacaagauacaggguagugaagacaagaaucuuc

SEQ ID NO: 6296 - RNA, 114 nt, Homo Sapiens
gaagcuaccugagguuuagaauuccuucagcccuagcugcuuuuauucugcuuuuuauuuaaacaaaaagagggggaggaucugaaggaaacuaguuuucuguacaaaggcuuu

SEQ ID NO: 6297 - RNA, 77 nt, Homo Sapiens
gaaggguaccugcuggagaccugugugguuugugggguggguuucuuauaucacugaaucuaaagugggugccuuuc

SEQ ID NO: 6298 - RNA, 72 nt, Homo Sapiens
gaaguuccaggcuguagugcacuaugaugaucguacguaugaacagccauugcacuccagccugggcaauuc

SEQ ID NO: 6299 - RNA, 117 nt, Homo Sapiens
gaauaaauaagcugcucuaauugccaagaauucacaugugguuguaugcagcauuacugggaaauugaaguguaucugcaugugauucugcugugauggacacuuguaaguuuguuc

SEQ ID NO: 6300 - RNA, 113 nt, Homo Sapiens
gaauaaauaagcugcucuaauugccaagaauucacaugugguuguaugcagcuuuacugggagacugaaguguaucugcaugugauucugcugugauggacacuuguaaguuu

SEQ ID NO: 6301 - RNA, 113 nt, Homo Sapiens; identical to SEQ ID NO: 6300

SEQ ID NO: 6302 - RNA, 111 nt, Homo Sapiens
gaauagcgaguugcccaagcucacaaaguaugugauggagcuagagauucaaacccaggccucucuggcuccuucuuuggggugggcuugcucugggaaaauaugcuauuu

SEQ ID NO: 6303 - RNA, 84 nt, Homo Sapiens
gaaucacuuaagcccaggaauuugaggcugcagugagcaaugacugugccacuguacuucagccuggguaacagaggggacuuc

SEQ ID NO: 6304 - RNA, 84 nt, Homo Sapiens
gaaucgcuugaaccugggaggaagagguugcagugagccgagauggcaccacugcacuccagccugggcaacagagcaagauuc

SEQ ID NO: 6305 - RNA, 108 nt, Homo Sapiens
gaaucugguugguuccuuaaagaucacuugacauggacaggguuuggaaaacuauuugaucauuacggagacugucaccgucaagagguguuuauuaucauuagguuu

SEQ ID NO: 6306 - RNA, 101 nt, Homo Sapiens
gaaugauuugaagggggcagucagagaaguaggaauaucaggagugguggucugauuacucugagaugugucuugauucuauuuuguuuucuuugaaauuc

SEQ ID NO: 6307 - RNA, 103 nt, Homo Sapiens
gaauuccuaaguauguggucuguauugugcuuguacugaccauguauauaugcuaugguuauuuagugcuagcuaagaacauaccauuuccccaguagcaguc

SEQ ID NO: 6308 - RNA, 90 nt, Homo Sapiens
gacagcagaacuuuucuauccaaaugaaugccgucccauggaaaguggcuguccugggaggcuacacguuucuccaauggugaugcuguu

SEQ ID NO: 6309 - RNA, 131 nt, Homo Sapiens
gacagcuggaauguucugaagaacugggugaucuugugaaaucuguggacccuacauuggcacuuaguguguaccuaagggcuaacgucccaaauaaagucauucagugcuuugcagaaacaggucaaguc

SEQ ID NO: 6310 - RNA, 82 nt, Homo Sapiens
gacaggauuccaguacaggucucucauuuccuucaugauuaggaauacuacuuugaaaugagagaccuguacuguaucuguu

SEQ ID NO: 6311 - RNA, 84 nt, Homo Sapiens
gacaugucaaggcaggagccaucugaucgaccuuagacuuggcaagcugguggcuaaguccagugcucacugccgacaucuguc

SEQ ID NO: 6312 - RNA, 64 nt, Homo Sapiens
gaccagccauccugguuuacaugggacgcaggaacugccguuuuaaagcugggcugaguugguc

SEQ ID NO: 6313 - RNA, 97 nt, Homo Sapiens
gaccaugaagccagagucuccaggacuccucacucaaccucggccauggacgcagguugggugugaggggggucccagccuuucggucuucuauuuc

SEQ ID NO: 6314 - RNA, 97 nt, Homo Sapiens; identical to SEQ ID NO: 6313

SEQ ID NO: 6315 - RNA, 74 nt, Homo Sapiens
gaccucaggaaagcuggguugagcugggcugagacaauuaaugucugucagcccaaacccggcacucugaccuc

SEQ ID NO: 6316 - RNA, 79 nt, Homo Sapiens
gagaacugggauggaggagaauuagaggauggugugguguuucccaagacauccccugaucuugcuaucccagcaucuc

SEQ ID NO: 6317 - RNA, 75 nt, Homo Sapiens
gagaacuguagugcaagguuuugccaacuuuuugaccagaauccucggugaguaauaaauuuugcacugcagcuc

SEQ ID NO: 6318 - RNA, 114 nt, Homo Sapiens
gagaagauaaaugcguuuucagggaugucaucuugggccugcuuuucucugaucguguagcgaugggcucauuuugcagugauuuauaccugauggccgugaaccuaucuucuc

SEQ ID NO: 6319 - RNA, 86 nt, Homo Sapiens
gagaaucacuugaacccaggaggcagagguugcagugagcugagauuaugccauugcacuccagccugggugacagagugaaacuc

SEQ ID NO: 6320 - RNA, 86 nt, Homo Sapiens
gagaaucacuugaacccaggagguggagguugcagugagccaagaucgugccauugcacuccagccuggguaacagagugggacuc

SEQ ID NO: 6321 - RNA, 86 nt, Homo Sapiens
gagaaucgcuggaacccaggaggaggagguuguggugagccaagaucgugccacugcacuccagccugggcaacagaacaagacuc

SEQ ID NO: 6322 - RNA, 92 nt, Homo Sapiens
gagaaucgcuggaacccaggaggaggagguuguggugagccaagaucgugccacugcacuccagccugggcaacagaacaagacuccgucuc

SEQ ID NO: 6323 - RNA, 92 nt, Homo Sapiens
gagaaucgcuugaacccaggagacugagguugcagugagcugagaucaugcaacugcacuccagccugggcaacacagcaagacuucaucuc

SEQ ID NO: 6324 - RNA, 91 nt, Homo Sapiens
gagaaucgcuugaacccaggagguggaggcugcaguaagccgagauugugccacugcacuccagccugggcaacaagagcaaaacuaucuc

SEQ ID NO: 6325 - RNA, 87 nt, Homo Sapiens
gagaaucgcuugaaccccggaggcagagauugcagugagccgagaucaugccacugcacuccagccugggcaacaagagcgaaacuc

SEQ ID NO: 6326 - RNA, 87 nt, Homo Sapiens
gagaaucucuugaacccaggaggcagaggugguggugagucgagauagcaccauugcacuccagccugggcaacaagagcgaaacuc

SEQ ID NO: 6327 - RNA, 86 nt, Homo Sapiens
gagaauugcuuaaacccgggagguggagguugcagugagccaagaucacgccacugcacuccagccugggcaacagagugagacuc

SEQ ID NO: 6328 - RNA, 86 nt, Homo Sapiens
gagaauugcuugaacccaggagguggagguugcagugagccgagaucacgcuacugcacuccagccugggugacagagugagacuc

SEQ ID NO: 6329 - RNA, 86 nt, Homo Sapiens
gagaauugcuugaacccaggagguggagguugcagugagcugagaccaugccauugcacuccagccugggcaacagagugagacuu

SEQ ID NO: 6330 - RNA, 86 nt, Homo Sapiens
gagaauugcuugaacccaggcaucggagguugcagugagccgagauugcaccaaugcacuccagccugggcgacagagcgagacuc

SEQ ID NO: 6331 - RNA, 86 nt, Homo Sapiens
gagaauugcuugaacccgggagguggagguuguagugagccgagaucgcgccacugcacuccagccugggcaacagagugagacuc

SEQ ID NO: 6332 - RNA, 87 nt, Homo Sapiens
gagaauugcuugaacccuggagguggagguugcagugagccgagauugcaccauugcacuccacccuaggcaacaagagcaaaacuc

SEQ ID NO: 6333 - RNA, 87 nt, Homo Sapiens
gagaauugcuugaaccugggagguggagguuguggugagccgaaauugugccauugcacuccagccugggcaacaagagcgaaacuc

SEQ ID NO: 6334 - RNA, 86 nt, Homo Sapiens
gagaauugcuugaacgccggggucggagguugcagugagccaugaucgcgccacugcacuccagccugggcaacagagcgagacuc

SEQ ID NO: 6335 - RNA, 85 nt, Homo Sapiens
gagaauugcuuuaacccgggagguggagguugcagugacugagaucgggccacugcacuccagccugggcaacagagagagacuc

SEQ ID NO: 6336 - RNA, 97 nt, Homo Sapiens
gagacagaagaaucgcuugaacucgggcggcggaaguugcagugagcugagauugcaccacugcacuccagccugggcaacagugagacucugucuc

SEQ ID NO: 6337 - RNA, 97 nt, Homo Sapiens
gagacaggaccuggcuucaggacuguggacugggcugcuggccugcuugcuuccucccuuccccauuccuagcagggccugaggcccuccucuucuc

SEQ ID NO: 6338 - RNA, 99 nt, Homo Sapiens
gagacaggagaaucacuugaauccgggaggcaaagguugcagugugucaagaucacaccacugcacuccagccugggcaacagagugagacuucaucuc

SEQ ID NO: 6339 - RNA, 99 nt, Homo Sapiens
gagacaggagaaucacuugaaucugagagguggaaguugcagugagccgagauugugccacugcacuccagccugggugacagagugaaacuccaucuc

SEQ ID NO: 6340 - RNA, 100 nt, Homo Sapiens
gagacaggagaaucgcuagaacccuagaggcagagguugcagugagcagagagagugccacugcacuccagccugggcaacaagagugaaauuccgucuc

SEQ ID NO: 6341 - RNA, 100 nt, Homo Sapiens
gagacaggagaaucgcuugaaccccagagguggagguuguggugagccgagauugcaccauugcacuccagccugggcaacaagagcgaaacuccgucuc

SEQ ID NO: 6342 - RNA, 100 nt, Homo Sapiens
gagacaggagaaucgcuugaacccgggaggcagagguugcagugagaugagaucacaccacugcacuccagccugggcaacaagagcgaaacuccaucuc

SEQ ID NO: 6343 - RNA, 99 nt, Homo Sapiens
gagacaggagaaucgcuugaacccgggagguggagguuacggugagugagaucgcgccauugcacuccagccugggcaacaagagcgaaacuccgucuc

SEQ ID NO: 6344 - RNA, 96 nt, Homo Sapiens
gagacaggagaaucgcuugaaccugggaggcagagguugcgguuagccaagauugugccacugcacuccaugggugacacagagagacucugucuc

SEQ ID NO: 6345 - RNA, 99 nt, Homo Sapiens
gagacaggagaauugcaugaacccaggaggcagagguugcagugagcugagcucgugccacugcacuccagccugggcaacaaagcgagacuccgucuc

SEQ ID NO: 6346 - RNA, 99 nt, Homo Sapiens
gagacaggagaauugcuugaaccuggcaggcggagguuacagugagccaagaugguaccacugcacuccagccugggcaacauagcaacacucugucuc

SEQ ID NO: 6347 - RNA, 98 nt, Homo Sapiens
gagacaggggaaucgcuugaaucugcaagguggagguugcagugagcugagauugugccacugcacuccagccuggcaacagaaugagacucuaucuc

SEQ ID NO: 6348 - RNA, 109 nt, Homo Sapiens
gagaccucuaucuauaaaaaaugaggcaggaguuggcaagaggucaagacugcaaugagccaugauccugccacuauacuccugccugggugaugggagacccugucuc

SEQ ID NO: 6349 - RNA, 106 nt, Homo Sapiens
gagacgugagaaucguuugaaccugggagguggagguuguagugagcccaaaucaugccacaugucacugcacuccagccuaggcaacagagcaagacucugucuc

SEQ ID NO: 6350 - RNA, 103 nt, Homo Sapiens
gagacucacccguucuacuggcaacuggaguuuguucaagaaauaccugaguugguucuuuaacugucgaguucgauuguccaaguggaagggugggagucuc

SEQ ID NO: 6351 - RNA, 108 nt, Homo Sapiens
gagagaggaaaugagaggagucggcuggggcgaguguggaccgcagcccagaguuagucuuggcugcagugcaacucuuucuaaaauguuauucucacgcccuuucuu

SEQ ID NO: 6352 - RNA, 101 nt, Homo Sapiens
gagaggcauugugagggagagaggugucaggaaugaaagaaugucuuaaaauucuaagcagucuuucuucuucuucucuuuauuaacagcaauuaacucuc

SEQ ID NO: 6353 - RNA, 99 nt, Homo Sapiens
gagaugagaggauugcuugaauccaggagguggaggcuguagugagcuaugauuguggcacagcaguccagccugggugacacaaggauacccugucuu

SEQ ID NO: 6354 - RNA, 102 nt, Homo Sapiens
gagauggaguuuugcucuuguugcccaggcuguaguguaauguagugcaaucuuggcuuaguacaaccucugccuccuggguucaagccauucuccugccuc

SEQ ID NO: 6355 - RNA, 131 nt, Homo Sapiens
gagauggcaauuuaaacugcuuugaugaccagguuucauuagguaagaaggcccgauuaagcaacgguggcccaaauaaccucagugguucagacacuguuuuucaaagccagcagaagucuugccaaauu

SEQ ID NO: 6356 - RNA, 98 nt, Homo Sapiens
gagaugggagaaucacuuaagcccaggaauuugaggcugcagugagcaaugacugugccacuguacuucagccuggguaacagaggggacuucauuuc

SEQ ID NO: 6357 - RNA, 99 nt, Homo Sapiens
gagaugggagguucacuugaacccaggagguggaggcuguggugagccaacauccugccacugcacuccagccugggcaacagagccaaacucugacuc

SEQ ID NO: 6358 - RNA, 89 nt, Homo Sapiens
gagauugcuugagcccagguaguugagacugcagugaaccaugauugugccacugcacucagccugggugacaguuaagacccugucuc

SEQ ID NO: 6359 - RNA, 109 nt, Homo Sapiens
gagcaaggacaaguugugaccuucccaguccucucuccauuugcagaucagcaagcuucugucagcaaggagggguggacaaugaaacuggguucagcuugauuuguuu

SEQ ID NO: 6360 - RNA, 76 nt, Homo Sapiens
gagccauuaaucucggggucucagccucucuuaacggaccuuccaggcacugcugagaaaaccagguuaaugguuu

SEQ ID NO: 6361 - RNA, 101 nt, Homo Sapiens
gagccuuuuaaugacacaguggggccaguuggagcacugauccuggucauuacuccugcacccuggccugcagccuuccucucagugucuuauuugggcuu

SEQ ID NO: 6362 - RNA, 88 nt, Homo Sapiens
gagcucccacggcuuuucuagaaauuggcacacaaacuccaaagcguguguggaaaugcagaugaccugggagacccaaaacaaccuc

SEQ ID NO: 6363 - RNA, 99 nt, Homo Sapiens
gagcugccagcauggcuagaaugaagcagguaggagaaauuggagagacuagacuuguugagucuuccagccuccaucuuucucccaugcuggaugcuu

SEQ ID NO: 6364 - RNA, 98 nt, Homo Sapiens
gagcuggagucucgcucugucacccaggcuggagugcaguggugcgaucuuggcucacugcaaccuccaccuuuguguucaagcaauucuccuuccuc

SEQ ID NO: 6365 - RNA, 101 nt, Homo Sapiens
gagcuguccgugacguagguuuguacgucaacucagccuuauucugggaaaucauuaauccuuaacucugaugacugugcaaaaguagucacugaccacuc

SEQ ID NO: 6366 - RNA, 88 nt, Homo Sapiens
gaggaucacgugagcccaggaggugaaggcuacagugaagugagaucaugcaacuguacuucagccugggcaacagagcaagauucuc

SEQ ID NO: 6367 - RNA, 82 nt, Homo Sapiens
gaggaucccugaguggggguugaggcugcagugagccaugaucaagccacugcacuccagccugggcaacacugagacacuc

SEQ ID NO: 6368 - RNA, 86 nt, Homo Sapiens
gaggaucccugaguggggguugaggcugcagugagccaugaucaagccacugcacuccagccugggcaacacugagacacucucuc

SEQ ID NO: 6369 - RNA, 87 nt, Homo Sapiens
gaggaugguuugagcccaggaggcagaaguugcagugagcugaaaucaugccacugcacuccagccugggugauagagccaaaccuu

SEQ ID NO: 6370 - RNA, 100 nt, Homo Sapiens
gaggcaagagaaucgcuugaacccaggaggcagagguugaagugagccgagaucgugccauugcacuccagccugggcaacaagagcgaaacuccgucuc

SEQ ID NO: 6371 - RNA, 99 nt, Homo Sapiens
gaggcaagagaauugcuugagcccgggaggcgaagguugcagugagcugagauggugccacugcacuccagccugggcaacagagcaagacugugucuc

SEQ ID NO: 6372 - RNA, 82 nt, Homo Sapiens
gaggcagaacuuccagugauucauuugguuguucauuuuguugggacugagaacagccagaugacuggauccacacugccuc

SEQ ID NO: 6373 - RNA, 99 nt, Homo Sapiens
gaggcagaagaaucacuucaaccugggagguggagguugcagugagcugacauugcgccacugcacuccagccugggcaacagagggacacucugucuc

SEQ ID NO: 6374 - RNA, 99 nt, Homo Sapiens
gaggcagaagaauggccugaacccaggaggcggagcuugcagugagcugagaucacgccacugcacuccagccugggcaacagagcaagacucugucuc

SEQ ID NO: 6375 - RNA, 96 nt, Homo Sapiens
gaggcagagaauugcucgaacccgggagacagagguugcagugagccgagauugugccacugcacuccagccugggcaacagagcgagacugcguc

SEQ ID NO: 6376 - RNA, 97 nt, Homo Sapiens
gaggcaggaaaaucgcuugaacccaaggcagagguugcagucagcagauauugcaccacugcacuccagccugggcaacaaagcaagacucugccuc

SEQ ID NO: 6377 - RNA, 97 nt, Homo Sapiens; identical to SEQ ID NO: 6376

SEQ ID NO: 6378 - RNA, 97 nt, Homo Sapiens; identical to SEQ ID NO: 6376

SEQ ID NO: 6379 - RNA, 99 nt, Homo Sapiens
gaggcaggacaaucacuugaacccaggaguuugaggcugcagugagccgagaucacgccacugcacuccacccugggcaacagagcaagaucuugucuc

SEQ ID NO: 6380 - RNA, 101 nt, Homo Sapiens
gaggcaggagaaauugcuugaacccaggagguagagguugcagugagucaagaucaugccauugcacuccaaccugggcgacaagagcaaaacucugucuc

SEQ ID NO: 6381 - RNA, 100 nt, Homo Sapiens
gaggcaggagaacagcuugaacccagguggcagagguugcagugagcugagaucaugccacugcacuccagccugggcaacaagagcgagacuccgucuc

SEQ ID NO: 6382 - RNA, 98 nt, Homo Sapiens
gaggcaggagaauaacuugaacccaggagacggagguuguugugagccgagaucgcgccauugcacuccagccugggcaacgagcgaaacuccgucuc

SEQ ID NO: 6383 - RNA, 99 nt, Homo Sapiens
gaggcaggagaaucacuugaacccgggagauggagguugcagugagccgagauggcgcaacugcacuccagccugggcaacaaauggagacucugucuc

SEQ ID NO: 6384 - RNA, 99 nt, Homo Sapiens
gaggcaggagaaucacuugaacccgggaggcugaggguacagugagccgagaucaugccacugcacucuagccucggugaccgaaggagacucugucuc

SEQ ID NO: 6385 - RNA, 99 nt, Homo Sapiens
gaggcaggagaaucacuugaacccgggagguggagguugcagugagcugagauugcgccacugcacuccagccugggcaacagagcgagacuccaucuc

SEQ ID NO: 6386 - RNA, 100 nt, Homo Sapiens
gaggcaggagaaucacuugaaccugggaaauggagguugcagugagccaagauugagccacugcacuccagccugggcaacaagagugaaacucugucuc

SEQ ID NO: 6387 - RNA, 100 nt, Homo Sapiens
gaggcaggagaaucacuugaaccugggagauggagguugcggugagccgagaucgcaucacugcacuccagccugggcaacaagagcgaaacucugucuc

SEQ ID NO: 6388 - RNA, 100 nt, Homo Sapiens
gaggcaggagaaucacuugaaccugggagguggagguugcagugagucgagauggcgccacugcacuccagccugggcaacaagagugaaacuccgucuc

SEQ ID NO: 6389 - RNA, 99 nt, Homo Sapiens
gaggcaggagaaucauuugaaccugggaaguggagguugcagugagccaagaucgugucacugcacucuagccuaggugauaaagcgagacucagucuc

SEQ ID NO: 6390 - RNA, 99 nt, Homo Sapiens; identical to SEQ ID NO: 6389

SEQ ID NO: 6391 - RNA, 99 nt, Homo Sapiens
gaggcaggagaaucgcuugaacccaggagauggagguugcagugagcugagaucacgccacugcacuccagccugggcaacagagugagacuccgucuc

SEQ ID NO: 6392 - RNA, 100 nt, Homo Sapiens
gaggcaggagaaucgcuugaacccaggaggcggagguugcagugagccaagauugcgccacugcacuccagccugggcaacaaaagcaaaacuucgucuc

SEQ ID NO: 6393 - RNA, 100 nt, Homo Sapiens
gaggcaggagaaucgcuugaacccaggaggcggagguuguggugagcgaagaucgugccauugcacuccagccugggcaacaagagcaaaacucugucuc

SEQ ID NO: 6394 - RNA, 99 nt, Homo Sapiens
gaggcaggagaaucgcuugaacccaggagguggagguugcagugugccgagaucgcgacacugcacuccagccugggcaacggagugaaauucugucuc

SEQ ID NO: 6395 - RNA, 100 nt, Homo Sapiens
gaggcaggagaaucgcuugaacccgggaaguggagguugcagugagccgagaucuugccauuguucuccagccugggcgacaagagugaaacuccaucuc

SEQ ID NO: 6396 - RNA, 100 nt, Homo Sapiens
gaggcaggagaaucgcuugaacccgggaggcggaggucguggugagccaaaaucgcaccauugcacuccagccugggcaacaagagugaaacucugucuc

SEQ ID NO: 6397 - RNA, 100 nt, Homo Sapiens
gaggcaggagaaucgcuugaacccgggaggcggagguuguggugagccaagauugcgccauugcacuccagccugggcaacaacagcgaaacucugucuc

SEQ ID NO: 6398 - RNA, 98 nt, Homo Sapiens
gaggcaggagaaucgcuugaacccggggggaggagguuacagugagcugagaucgcgccacugcacuccagccugggcaacaagagugaaacugucuc

SEQ ID NO: 6399 - RNA, 98 nt, Homo Sapiens
gaggcaggagaaucgcuugaaccuggcagguggagguugcagugagccgagaucgcaccauugcacuccagccugggcaacaagcacaaaacugucuc

SEQ ID NO: 6400 - RNA, 100 nt, Homo Sapiens
gaggcaggagaaucgcuugaaccugggaggcagagguuguggugagccgagaugaggucauugcacuccagccugggcaacaagugugaaacuccgucuc

SEQ ID NO: 6401 - RNA, 99 nt, Homo Sapiens
gaggcaggagaaucgcuugaaccugggagguggagguugcagugagccgagaucaugccacugcacuccagccugggcaacagagcgagacuucgucuc

SEQ ID NO: 6402 - RNA, 97 nt, Homo Sapiens
gaggcaggagaaucgcuugaaccugggagguggagguuguggugagccgagaucgcgccauugcacuccagccugggcaagagcaaaacucugucuc

SEQ ID NO: 6403 - RNA, 100 nt, Homo Sapiens
gaggcaggagaaucgcuugaaucuaggaaucagagguugcagugagccaaggucacaccacuugcacuccacagccugggugacagagugagacugccuc

SEQ ID NO: 6404 - RNA, 100 nt, Homo Sapiens
gaggcaggagaaucgcuuuaacccgggaggcagagguuguggugagccgagaucgcgccauugcacuccagccugggcaacaagagcggaauucugucuc

SEQ ID NO: 6405 - RNA, 100 nt, Homo Sapiens
gaggcaggagaaucgguugaacccaggaggcagagguuguggugagccgagaucguaccauugcacuccagccugggcaacaagagcaaaacuccgucuc

SEQ ID NO: 6406 - RNA, 98 nt, Homo Sapiens
gaggcaggagaaucguuugaaccugggaagcggagguugccgugagucgagaucaugccauugcacuccagccugggcaacaagagcgaaacucucuc

SEQ ID NO: 6407 - RNA, 100 nt, Homo Sapiens
gaggcaggagaaucguuugaaccugggaggcggagguuguguugagccgagaucucgccauugcacuccagccuaggcaacaagagcgaaacuccaucuc

SEQ ID NO: 6408 - RNA, 99 nt, Homo Sapiens
gaggcaggagaauggcaugaacccaggaggcggagcuugcagugagccgagauugcgccacugcacuccagccugggcaacggagcaagacuccaucuc

SEQ ID NO: 6409 - RNA, 99 nt, Homo Sapiens
gaggcaggagaauggccugaaccuaggagguggagcuugcagugagccgagauagcgccacugcacuccagccugggcaacagagcgagacucugucuc

SEQ ID NO: 6410 - RNA, 99 nt, Homo Sapiens
gaggcaggagaauggcgcgaacccgggaaguggagcuugcagugagccgagaucgcgccacugcacuccagccugggcaacagagcgaaacuccgucuc

SEQ ID NO: 6411 - RNA, 99 nt, Homo Sapiens
gaggcaggagaauggcgugaacccgggaggcagagcuugcagugagcccagauugcgccacugcacuccagccugggcaacagagcgagacuccgucuc

SEQ ID NO: 6412 - RNA, 99 nt, Homo Sapiens
gaggcaggagaauggcgugaacccgggaggcggagcuugcagugagccgagaucaugccacugcacuccagccugggcaacagagcgagacuccgucuc

SEQ ID NO: 6413 - RNA, 100 nt, Homo Sapiens
gaggcaggagaauuacuugaaaccaggagguggagguugcggugagucgagaucgugccacugcacuccagccugggcaacaagagcaaaacuccgucuc

SEQ ID NO: 6414 - RNA, 97 nt, Homo Sapiens
gaggcaggagaauugcuucaaacugggcagagguugcagugagccaagguugacccacugcacuccagccugggcaacaagagcaaaacuccaucuc

SEQ ID NO: 6415 - RNA, 98 nt, Homo Sapiens
gaggcaggagaauugcuugaacccaggaagcagagguugcggugagcugaaucaugccacugcacuccagccugggcaacagagcagcacuucgucuc

SEQ ID NO: 6416 - RNA, 100 nt, Homo Sapiens
gaggcaggagaauugcuugaacccaggaaguggaggcuucagugagcugagaacacgccacugcacuccaguccugggcaacagagcaagacucugucuc

SEQ ID NO: 6417 - RNA, 99 nt, Homo Sapiens
gaggcaggagaauugcuugaacccaggaggcagaagcugcagugagccaagauagugccacugcacuccagccugggcaacagagcgagacuccgucuc

SEQ ID NO: 6418 - RNA, 99 nt, Homo Sapiens
gaggcaggagaauugcuugaacccaggaggcagaaguugcagugagccgagaucgcaucauugcacuccagccugggcaacagagcgagacucugucuc

SEQ ID NO: 6419 - RNA, 97 nt, Homo Sapiens
gaggcaggagaauugcuugaacccaggaggcggagguuguagugagcugagaucacgccacugcacuccagccugggcaacagagcaagacugucuc

SEQ ID NO: 6420 - RNA, 99 nt, Homo Sapiens
gaggcaggagaauugcuugaacccaggagguggagguugcagugagcugagaccaugccauugcacuccagccugggcaacagagugagacuugguguc

SEQ ID NO: 6421 - RNA, 100 nt, Homo Sapiens
gaggcaggagaauugcuugaacccgggagguggagguugcggugagccgaggucgcgccauugcacuccagccugggcaacaagagcgaaacuccgucuc

SEQ ID NO: 6422 - RNA, 99 nt, Homo Sapiens
gaggcaggagaauugcuugaaccugggaggcagagguugcagugagcugaaaucgcgccacugcacuccagccugggcaauagggcaagacuccgucuc

SEQ ID NO: 6423 - RNA, 100 nt, Homo Sapiens
gaggcaggagaauugcuugaaccugggaggcggagguuguggugagccaaggucgcgccauugcacuccagccugggcaacaagggcaaaacucugucuc

SEQ ID NO: 6424 - RNA, 99 nt, Homo Sapiens
gaggcaggagaauugcuugaaccugggaggugaagguugcagugagcugagaccaugccacugcacuccagccugggcaacagagcaaaacuccgucuc

SEQ ID NO: 6425 - RNA, 100 nt, Homo Sapiens
gaggcaggagaauugcuugaaccugguggggcagagguugcagugagccgagauaacgcuacugcacuccagccugggcaacagaguaaaacuccgucuc

SEQ ID NO: 6426 - RNA, 98 nt, Homo Sapiens
gaggcaggagaauugcuugaacucagggucagaggucgcagugagccgagaucccuccacugcacuccagccugggcaacagagugagucucugucuc

SEQ ID NO: 6427 - RNA, 98 nt, Homo Sapiens
gaggcaggagaauugcuugaacuugaaaggcagagguugcagugagccgaaauugcaccacugcacuccagccuggcgacagagcaagacuccaucuc

SEQ ID NO: 6428 - RNA, 99 nt, Homo Sapiens
gaggcaggagaauugcuugagcccaggaggcggagauugcagugagccgagaucgugccacugcacuccagccugggcaacagagugagacucugucuc

SEQ ID NO: 6429 - RNA, 97 nt, Homo Sapiens
gaggcaggagacucgcuugaacccaggaggcggagguugcagugaggugagauggcgcuacugcacuccagccugggcaacagauugagacugucuc

SEQ ID NO: 6430 - RNA, 99 nt, Homo Sapiens
gaggcaggagaguugcuugaacccaggaagcggagguugcagugagcugagauugccucacugcacuccagccugggcaacagagugaaacaaugucuc

SEQ ID NO: 6431 - RNA, 99 nt, Homo Sapiens
gaggcaggaggaucacuugaguguggaagguugaggcuguagugagccaugauugcaccacugcacuccagccugggcaacagagagacauccuuucuc

SEQ ID NO: 6432 - RNA, 99 nt, Homo Sapiens
gaggcaggaggaucgcuugaacccgggaggcagagguugcagugagccaagauugcgccacugcacuccagccugggcaacagagugagacucugucuc

SEQ ID NO: 6433 - RNA, 99 nt, Homo Sapiens
gaggcagggaaaucgcuugaacccaggagacagagguuucagugagccgagaucgugccacugcacuccagccugggcaacagagugagacucugucuc

SEQ ID NO: 6434 - RNA, 97 nt, Homo Sapiens
gaggcauaagaaucgcuugaauucgggagguggagguugcagugagccaagaucacaccacugcacuccagccugggugacagcaagacucugucuc

SEQ ID NO: 6435 - RNA, 101 nt, Homo Sapiens
gaggccaggagucugagaucagcuugggcaacugauuuaugguuuggauuuguguccaugcccuuccucuucugccaugauuauaaguuuccugaggccuc

SEQ ID NO: 6436 - RNA, 98 nt, Homo Sapiens
gaggcgaagaauugcuugaacccaggagguggagguugcagugagccaagaucaugccacugcacuccagccugggcaacagagcaagacucugucuc

SEQ ID NO: 6437 - RNA, 99 nt, Homo Sapiens
gaggcgggagaauugcuugaacccgggagguggagguugcagugagccgagaucgcgccauugcacuccagccugggcaacagagcaagacucugucuc

SEQ ID NO: 6438 - RNA, 105 nt, Homo Sapiens
gaggcugagacaggagaauugcuugaacccaggagguggagguuucagugagccaagauuguaccacugcacuccagccugggcaacagagcgagacuccgccuc

SEQ ID NO: 6439 - RNA, 105 nt, Homo Sapiens
gaggcugaggaaagaagauugcuugagcccaggaauuagaggcugcaaugagcuaugaucaugccacugcacuccauccuggggagcagagcuagacucugucuc

SEQ ID NO: 6440 - RNA, 105 nt, Homo Sapiens; identical to SEQ ID NO: 6439

SEQ ID NO: 6441 - RNA, 105 nt, Homo Sapiens; identical to SEQ ID NO: 6439

SEQ ID NO: 6442 - RNA, 105 nt, Homo Sapiens; identical to SEQ ID NO: 6439

SEQ ID NO: 6443 - RNA, 105 nt, Homo Sapiens; identical to SEQ ID NO: 6439

SEQ ID NO: 6444 - RNA, 105 nt, Homo Sapiens; identical to SEQ ID NO: 6439

SEQ ID NO: 6445 - RNA, 94 nt, Homo Sapiens
gagggagaauugcuugagcccaggauuucgaggcugcagugagcuaugaucacaccacugcacuccagccugggcaacagagcaagacucuguc

SEQ ID NO: 6446 - RNA, 94 nt, Homo Sapiens
gagggagccacggucagauuucaaguggucauuucacucuuucucccucugggggacugagacaugauuaacuugcaauaauugugacucccuc

SEQ ID NO: 6447 - RNA, 84 nt, Homo Sapiens
gagggcugucaccauuagcacucucggagcugggagaagucccugagcccugaaggguguuuugggcaguaugugacagugcuc

SEQ ID NO: 6448 - RNA, 96 nt, Homo Sapiens
gagggcuuuagaaaugcugugccagagcugcaccccagaccaacaaaaucagacucuccaggaugcggccaaggcaucaguauguggaaagcuuuc

SEQ ID NO: 6449 - RNA, 93 nt, Homo Sapiens
gaggggagauuaaagaaucaauguucccaggggaaaagggccuuaaauuguuuggucuuuucaauggcugacacugucuccaacucuccccuu

SEQ ID NO: 6450 - RNA, 81 nt, Homo Sapiens
gagguaaagcuggggcugggguuccuuaugcaaagagagcugucucuuuaguaggaacucuggauuggcucauuuugcuuu

SEQ ID NO: 6451 - RNA, 87 nt, Homo Sapiens
gagguaaguuugaacccaggagggagagguuguggugagccaagauggcaccauugcacuccagccugggugacagagugagacuuc

SEQ ID NO: 6452 - RNA, 99 nt, Homo Sapiens
gagguaggagaacugcuugaacucaggaggcgggggcugcaaugagcugagaucaagccacugcacuccagccuaugggauagagugagauuccaucuc

SEQ ID NO: 6453 - RNA, 85 nt, Homo Sapiens
gagguaggugcuuuaacugugugcacccugugagguaggugcuuuaacugugugcacauugugagguaggugcugaaacugcuuc

SEQ ID NO: 6454 - RNA, 85 nt, Homo Sapiens
gaggucauaaugugaauguuguaugcaguggccaugucaucagaacaggugugccagcccccugcauggaacauguacaugcuuc

SEQ ID NO: 6455 - RNA, 99 nt, Homo Sapiens
gaggugggaggaucgcuugagcccaggaggucaaggcugcagugaguugugaucaugccacugcacuccagccugggcaacaaagcaagaccccaucuc

SEQ ID NO: 6456 - RNA, 99 nt, Homo Sapiens
gaggugggaggauuacuugagcccaagaggaggaggcugcagugagucaacauugcaccacugcacuccagccugggcaacagagugugaccccaucuc

SEQ ID NO: 6457 - RNA, 98 nt, Homo Sapiens
gaggugggaggauugcuuguuccccggagguugaagcuacagugagccuugauugugucacugcacuccagccugggcaacagguaagacucugucuc

SEQ ID NO: 6458 - RNA, 101 nt, Homo Sapiens
gaggugggagggucacuugagcccagaauuucaaggcugcagugagcuaugauuaagccacugcacuccagccugggcaacagagugagaccuccaacuuu

SEQ ID NO: 6459 - RNA, 104 nt, Homo Sapiens
gaguaaggggcagagcgcugccucucugcaggccgugugcuuugcucgguugaucuugcagagccuaagacacaggcccagagaggcagugaucgccaaagauc

SEQ ID NO: 6460 - RNA, 92 nt, Homo Sapiens
gaguagcaaaggccccagggaaugggcucuguugggacagcuugucuuugguuuccaguaguuacuccucccugaaggggucaagguugcuu

SEQ ID NO: 6461 - RNA, 93 nt, Homo Sapiens
gaguagcugggauuacaggugugugccaccaugucuggcugauuuuuguauuuuuaguagaggugggguuucaccauguuggccaggcugguc

SEQ ID NO: 6462 - RNA, 93 nt, Homo Sapiens; identical to SEQ ID NO: 6461

SEQ ID NO: 6463 - RNA, 100 nt, Homo Sapiens
gagucaggagaaucgcuugaacucgggagguggagguuguggugagcuaagaucacaccauugcacuccagccugggcaacaagagcgaaacuccaucuc

SEQ ID NO: 6464 - RNA, 86 nt, Homo Sapiens
gagucucgcucuguugcucaggcuggagugcaguggugcaaucuuggcucacugcaaccuccaucuccuggguuuaagcgauucuc

SEQ ID NO: 6465 - RNA, 102 nt, Homo Sapiens
gagugaccccaucucuacaaaaaguuuuuuuaaauuagcuaggcauggugguauacacuuguaguccuagcuacuuaggaagcugaggcaggagggucacuu

SEQ ID NO: 6466 - RNA, 101 nt, Homo Sapiens
gaguuugagaucugucugggcaacaugcugaaaccccagcucuguaaacaauacaaaaauuagcugggcguggcggucugugccuacagucccagcuacuc

SEQ ID NO: 6467 - RNA, 103 nt, Homo Sapiens
gauacauaguggucacuuccauuuaagauguuugcauuucagcacuuuuauaauucaaauauggugcugucccuugagacucuuguugagagccacauguauc

SEQ ID NO: 6468 - RNA, 87 nt, Homo Sapiens
gauauguuucuacuagugguugauggccucuuucagcuccaucgcuauggaggcgagguucaucaauaacucagagaaacuuguguc

SEQ ID NO: 6469 - RNA, 93 nt, Homo Sapiens
gaucauaagcucccugaaaacacguugcaucugugucucuagcaacuuccacaaauguuuggagaauaaauuaauguguggcagggcgcgguc

SEQ ID NO: 6470 - RNA, 98 nt, Homo Sapiens
gaucauuugagaccagaaguuccaggcuguagugcacuaugaugaucguacguaugaacagccauugcacuccagccugggcaauucagcaagacauc

SEQ ID NO: 6471 - RNA, 111 nt, Homo Sapiens
gauccagauagaugauauguuucuacuagugguugauggccucuuucagcuccaucgcuauggaggcgagguucaucaauaacucagagaaacuuguguccagaguugguc

SEQ ID NO: 6472 - RNA, 130 nt, Homo Sapiens
gaucccaaaaacucaucucagucuauguccuugcuauguauguacaaaaaugagaaauguaaauuguguuuaaaaaccuuaucucauuacauacuuucucaaaccacucuuugagugucauuuuuggguc

SEQ ID NO: 6473 - RNA, 88 nt, Homo Sapiens
gaugaggugaaagagaugggacagugacuguaucuguucugaugaaggagauugugcaguuacaugcguaacgucauuaaacuucauu

SEQ ID NO: 6474 - RNA, 76 nt, Homo Sapiens
gaugggauggagcaagaggugaagaucuuggagucuggaaucagaccaccuggauuuucauccuaguuccccgauc

SEQ ID NO: 6475 - RNA, 79 nt, Homo Sapiens
gauggucucauaacugaauauauuaaaaacuuaaauuguauacuuuaaguuggugauuguaugauauaugaguuuuauc

SEQ ID NO: 6476 - RNA, 60 nt, Homo Sapiens
gauguguucaagaaaauuuauugcagcauuguuugcaauagugaaaaaacugaacucauc

SEQ ID NO: 6477 - RNA, 94 nt, Homo Sapiens
gauucaaagcaagaugguagcauuggagaggaugagauauggucagaugaggauauauuuuaaaaguugagcuaacaggauuugcugaggaauc

SEQ ID NO: 6478 - RNA, 89 nt, Homo Sapiens
gauucuguugaggauauaucccuaugaugucccugggaagcgauggggcauucccagucaucugggaugugcaguuucuaaauauuauc

SEQ ID NO: 6479 - RNA, 77 nt, Homo Sapiens
gcaaagcaaguggcuuggagagauagugauuuagcucaagagggagugagaugugacuguugccacauguuaaaugc

SEQ ID NO: 6480 - RNA, 85 nt, Homo Sapiens
gcaaagcacuuacuucuuugcagaugagacugagacauaguuacaaagucucaguuuccucugcaaacaguuguaagugcuuagc

SEQ ID NO: 6481 - RNA, 84 nt, Homo Sapiens
gcaaggugcuagguuuuuuccuuuccccaccugucucuuagccuggggaauuaaaugagaagccuuagaauggguggcccuugu

SEQ ID NO: 6482 - RNA, 74 nt, Homo Sapiens
gcaagguuugggaaauaagcugauaguaaagucauguaacacuuucugugcagguuaacauuucuggaccuugc

SEQ ID NO: 6483 - RNA, 87 nt, Homo Sapiens
gcaaugcuguuuacuuauaggaugaaacuguaucagacuuuguaguggcugugcauguugauauccuggccaguaggcagugcgugc

SEQ ID NO: 6484 - RNA, 82 nt, Homo Sapiens
gcacagugagagaaacagacuccaccacaccuucuuggcugugcaaggaagucagaugauguuggagucugugcuacugugc

SEQ ID NO: 6485 - RNA, 113 nt, Homo Sapiens
gcaccagaaaguccaggaagagcugauuaaaguguuagcuggcugacacauuaugguggugugguagaaagugucucauuuuaauaagucacagugcugccuaaucugugugc

SEQ ID NO: 6486 - RNA, 91 nt, Homo Sapiens
gcacccugugagguaggugcuuuaacugugugcacccugugagguaggugcuuuaacugugugcacauugugagguaggugcugaaacugc

SEQ ID NO: 6487 - RNA, 76 nt, Homo Sapiens
gcagaggcagaugggacucugugcccauugaagaacuugggaguguauucugggaacaggcacccaucuucucugc

SEQ ID NO: 6488 - RNA, 89 nt, Homo Sapiens
gcagcaggcagggccaggcagggccgggccuggggccugguguccgaccgcagcccagccccccucaucgccugacacucugccucugc

SEQ ID NO: 6489 - RNA, 80 nt, Homo Sapiens
gcagcauggaagaauaggcaguauuggauuugaaaucaggagacuuggaauugaauucugccucuuccacuaccagcugu

SEQ ID NO: 6490 - RNA, 81 nt, Homo Sapiens
gcagcgacgcugaguuucaagaaagccaagauggcugaguccacaggcucacccacgggugcguuuagacugggaugcugc

SEQ ID NO: 6491 - RNA, 69 nt, Homo Sapiens
gcagcugcagaaaacacagccgaguugcuagcuaaggggaaacagacgccgcugugggaaagcacuugu

SEQ ID NO: 6492 - RNA, 93 nt, Homo Sapiens
gcaggaggauugcuugagcccaggaguucaaggcuacaaugagcuaugaucacacuacuacacuccagccugggcaacagagcaagacccugu

SEQ ID NO: 6493 - RNA, 103 nt, Homo Sapiens
gcaggcagggagagggaggaggugaaggaacaaaugcugaacaccuguuauuuaugaagcacucuacauauguucuuucauuucacuccuggugaaaaccugc

SEQ ID NO: 6494 - RNA, 89 nt, Homo Sapiens
gcagggagacuggagagaaagcgaagauguagcccaaagccauagugcuuugugugcccugcaacugagcuuucccugcagcuuucugu

SEQ ID NO: 6495 - RNA, 99 nt, Homo Sapiens
gcagggagagggaggaggugaaggaacaaaugcugaacaccuguuauuuaugaagcacucuacauauguucuuucauuucacuccuggugaaaaccugc

SEQ ID NO: 6496 - RNA, 88 nt, Homo Sapiens
gcagggauucauggacuagguuugcaccuucugaaccaugagcuagaccaugucuggaggcuggaaccuggugacccaggcucccugc

SEQ ID NO: 6497 - RNA, 85 nt, Homo Sapiens
gcagguaugauggccuuuucucuuauccugguuccugcagagcugacugccaugcuugggagagggaaaagacuuauuugccugu

SEQ ID NO: 6498 - RNA, 111 nt, Homo Sapiens
gcagguccaucuucaguggcauugggccuuggcugggaugcugaguuauccacuggagcaucggcaguacaggcaggcacagaggcaguggauccaucggagguggcaggu

SEQ ID NO: 6499 - RNA, 117 nt, Homo Sapiens
gcagucugcgggaccagacuauugugacauggagaauguagagaaauuauucaauguucaggaucaacaugaucuccucacucuaggauggauccauacacaucccacucaaacugc

SEQ ID NO: 6500 - RNA, 108 nt, Homo Sapiens
gcaucuugacacauguucugugcuccaggucccaguaacugugcccauccauuguuaccacaggucacaguggcccuggcccuggggcauuauacucucucuuggugu

SEQ ID NO: 6501 - RNA, 80 nt, Homo Sapiens
gcauuaaaauaauuaaagugucugaggccuuccccuucaauaaaucugggauugggcccaggcaacuguguuuuuuaagc

SEQ ID NO: 6502 - RNA, 79 nt, Homo Sapiens
gcauugcuugaguccaggaggucaaggcugcagugagucaaggucaugccacugcacuccauccugggacagagcaagc

SEQ ID NO: 6503 - RNA, 90 nt, Homo Sapiens
gcccaggcuagaauucaguggcaggaucauagcucacugcagccucgaacuccuaggcucaagcaauccuccugcuucugccuccugggu

SEQ ID NO: 6504 - RNA, 83 nt, Homo Sapiens
gccccugcccaagagauccacuuuauuuucaucucacccagaauauugaggugaucagcaagguggagugguugggagagggu

SEQ ID NO: 6505 - RNA, 92 nt, Homo Sapiens
gcccggugcucgguuuguaggcagugucauuagcugauuguacuguggugguuacaaucacuaacuccacugccaucaaaacaaggcacagc

SEQ ID NO: 6506 - RNA, 114 nt, Homo Sapiens
gcccuaaacgaagggggccucaaguuacgacuucucaaggcagugacaucuuccucaauugguaugaguagcugccaggcaacaaguacguauaagagugucccauauucuggc

SEQ ID NO: 6507 - RNA, 105 nt, Homo Sapiens
gcccugaacucaggggcuucgccacugauuguccaaacgcaauucuuguacgagucugcggccaaccgagaauuguggcuggacaucuguggcugagcuccgggc

SEQ ID NO: 6508 - RNA, 107 nt, Homo Sapiens
gcccuuagaaauuguuaugauugucccagaaauccaggcuuaaaugauacucagguguaauauucaagauaagggucugggagaauauaaaauauuaauuugagggu

SEQ ID NO: 6509 - RNA, 74 nt, Homo Sapiens
gcccuucagucucaguagccacauuucaagugcucaauaguuacaugugcccaguggcugcuggacuggguggu

SEQ ID NO: 6510 - RNA, 96 nt, Homo Sapiens
gccguagaagagagccagcaugguguggcagaaggcucuggauuaguccuggguucuaguucugggucuucuacaaaccagcuccaugaauuaggc

SEQ ID NO: 6511 - RNA, 76 nt, Homo Sapiens
gccucuggacaauacuguuaaaacuaaauacuugccaggugugguggcucacaccugugauaguucuuuuggaggc

SEQ ID NO: 6512 - RNA, 88 nt, Homo Sapiens
gccugcgggguauuguagaaacgcugcgcugccuaucacagcuugugaugugacacguucauucugcaaguuuaaacuucgccuaggu

SEQ ID NO: 6513 - RNA, 87 nt, Homo Sapiens
gccuugcagugaaggaggcaugugaucaccaucaaagucuucugcucugggaaggaucacacagucguccuucagccugccuggggc

SEQ ID NO: 6514 - RNA, 77 nt, Homo Sapiens
gccuuggcuucccaaagugcuaggaauacaggugugagccaacaugccuguccuguaaguauuuuuuaaaacaaggc

SEQ ID NO: 6515 - RNA, 108 nt, Homo Sapiens
gcgaucucuuaacaauuuccgggcugaacagccucaccagcaugccauguacuaccuccgcuugcugaugacugaaguggccuggacuaaagaugaguuaaaagaagc

SEQ ID NO: 6516 - RNA, 101 nt, Homo Sapiens
gcgcugucuuccugggcucagcauccugggacacaggacauuguaguggagcaucccaaccugaaacuuugucucaguguagagacccagaaagauggggu

SEQ ID NO: 6517 - RNA, 70 nt, Homo Sapiens
gcgggcuaggcagucucaguuguuggguuuucuuagugaaauaagcagcaacaaacgacaacaaaaccgc

SEQ ID NO: 6518 - RNA, 86 nt, Homo Sapiens
gcgucacggaaugcuguccugaucccuagcauuuacucacaugcugugcuuagugcuugaccaugugguggcagauucugugaugu

SEQ ID NO: 6519 - RNA, 72 nt, Homo Sapiens
gcgugaaccugggaggcggagcuugcagugagccgagaucgugccacugcacuccagccugggcaacagagc

SEQ ID NO: 6520 - RNA, 102 nt, Homo Sapiens
gcguuccugggaaaaccauuuagauuucauucuccuuccuuucucugacagaagcugcuggugaggaagguaaugaucuugaucaaaccauccccagaaugc

SEQ ID NO: 6521 - RNA, 129 nt, Homo Sapiens
gcuacucaggaggcugaggcaggaggaucacuugagccugggaggucuaggcugcagugagccgggacgaugccacugcacuccagccugggcaacagagugagacccugucccagcacucugggaggc

SEQ ID NO: 6522 - RNA, 96 nt, Homo Sapiens
gcuacuucuaugugucccaugguacugccacagaagagucucagcucucuccaggauucaguucuaaggucagugccuaagauaaaaauggagugu

SEQ ID NO: 6523 - RNA, 91 nt, Homo Sapiens
gcuaggauugcaccacugcacuccaaccuggacaacagagcaagacccugucucuaggccaggugcaguggcucacaccuguaaucccagc

SEQ ID NO: 6524 - RNA, 91 nt, Homo Sapiens; identical to SEQ ID NO: 6523

SEQ ID NO: 6525 - RNA, 91 nt, Homo Sapiens; identical to SEQ ID NO: 6523

SEQ ID NO: 6526 - RNA, 91 nt, Homo Sapiens; identical to SEQ ID NO: 6523

SEQ ID NO: 6527 - RNA, 131 nt, Homo Sapiens
gcuagucacuggggcaaagaugacuaaaacacuuuuccugcccucgaggagcucacagucuaguaugucucauccccuacuagacugaagcuccuugaggacagggauggucauacucaccucgguguugc

SEQ ID NO: 6528 - RNA, 104 nt, Homo Sapiens
gcuaguguggacacacagcucuuggaaagcauguacauuuggaggauauagugucuucuaaauaauuauacacuuucuaugagaguaggguggcuuacaguggc

SEQ ID NO: 6529 - RNA, 89 nt, Homo Sapiens
gcuaucaguucuugcuauucucagagcacucuaucauguuuuuagguguauauuguguauucaggauagcauuaaaaagaacugauggc

SEQ ID NO: 6530 - RNA, 107 nt, Homo Sapiens
gcuauugugacaaucuugguuaccauccauuaagugcugcugauuuuggaaagaucaugaaaaacgucuuuccaaacaugaaggcacgucguuugggcacaagaggc

SEQ ID NO: 6531 - RNA, 110 nt, Homo Sapiens
gcucacaaaaccuagguggggaugaaagcugagaaagcgaagaggugguucaggggaucacucuuuccuacuuguuccucucaccucaaacucaccuucuacugcacagc

SEQ ID NO: 6532 - RNA, 123 nt, Homo Sapiens
gcucacacagcaagucuuugucaaagcuuaggaauggaaguagguuguccccuccuagucaugggaucucuccaacucacuagacaaucuugcuuuacgugcugaugaacaugcucugugagc

SEQ ID NO: 6533 - RNA, 74 nt, Homo Sapiens
gcuccugcuugcauaugcauggguacacagccuguaacuacaugugugugagccuguggguaugugaggggagu

SEQ ID NO: 6534 - RNA, 72 nt, Homo Sapiens
gcucgaacccagaagguggaguuugcagugagccgagaucgugccacugcacuccagccugggcaacacagc

SEQ ID NO: 6535 - RNA, 72 nt, Homo Sapiens
gcucgaacccgggagacagagguugcagugagccgagauugugccacugcacuccagccugggcaacagagc

SEQ ID NO: 6536 - RNA, 113 nt, Homo Sapiens
gcucguugcccaggcuggagugcaauggcgugaucuuggcucaccacaaccuccacuucccagguucaagcgauucucaugccuuagccucccaaguagcugggauuacaggc

SEQ ID NO: 6537 - RNA, 111 nt, Homo Sapiens
gcucugucuugagaaucgagaaauauggggcucuuuucugucuuugcgauuuuggcuaucaauuuguagcagaacacuggguccaguuucuucauuaucucuuuacugagc

SEQ ID NO: 6538 - RNA, 108 nt, Homo Sapiens
gcucuucccauaccaugcauuccuagccccacagaaauccacuagucugggcuuucucugcgauuggcugaggcagcaacuggugaggcaccugggcugugcaggagc

SEQ ID NO: 6539 - RNA, 76 nt, Homo Sapiens
gcucuuguugcccaggcuggagugcaguggcaugaucucagcucacugcaaccucugccaccuggguucaagcugu

SEQ ID NO: 6540 - RNA, 90 nt, Homo Sapiens
gcucuuuaagaaguaagcagaacuguuuuguuuucugugcugcuuagugcaggacaauauagagcagaucuggcucugccccuuagcagc

SEQ ID NO: 6541 - RNA, 90 nt, Homo Sapiens
gcugcaguggaaaggaguuugugacauugacauugacagcaugaaaaugggucuugccagugcaugugagacugccucccaacacucagc

SEQ ID NO: 6542 - RNA, 98 nt, Homo Sapiens
gcugcauccugccuggcucccaggaggccucucucagcauuuucugacaacaaagccggggcugcagaucccuggugagauuccaggcuagcaucagc

SEQ ID NO: 6543 - RNA, 74 nt, Homo Sapiens
gcugcugcugaagucaccugaaaacucaacuaagcuaaagagccuagauggguuacucagaugacuggcagugc

SEQ ID NO: 6544 - RNA, 99 nt, Homo Sapiens
gcugcuuuccuaucuuacccuuccugcucuccuuuuuguagugaugaggaacaaugaaaaagagguaguguaaggaauugugaggcugggcaugguggc

SEQ ID NO: 6545 - RNA, 99 nt, Homo Sapiens
gcuggauauugcuaagaauucagguagucucgggaucuccagagucuccauacuaggacaggagaucuucagaaccuggaggaauggaaauagucuagu

SEQ ID NO: 6546 - RNA, 102 nt, Homo Sapiens
gcuggaugaugaauccuuguuuuucagguggcuccaaaaagaauguugcauguguucagaccauccugagcagagccaccaaauuuagugacagugucuagc

SEQ ID NO: 6547 - RNA, 71 nt, Homo Sapiens
gcuggggagggaguuuacauguuuucuaauggagccauuaucuguuggaggcauucauuccccucaccagc

SEQ ID NO: 6548 - RNA, 86 nt, Homo Sapiens
gcuguaacacagagcagguuuggaauggcuccacccacagggccacaagaaacaaacccauggagaguuccagaucuguuugcagc

SEQ ID NO: 6549 - RNA, 85 nt, Homo Sapiens
gcugucagaucagguuccugauuggaguucucuuaucugcucugguuuggagggcugccccauucgggaaucuguuuuguuuugc

SEQ ID NO: 6550 - RNA, 92 nt, Homo Sapiens
gcuguccugaggccuggagauacuagaggguaaaggaauggaaccaugucuggggucccuuuaguaacuugcagggucugggaauugacugc

SEQ ID NO: 6551 - RNA, 85 nt, Homo Sapiens
gcuguccuggagcuguuggagaaauggggaagaucaucuagauauuccaguuucuccuuccacucacccuauaguaccggauagc

SEQ ID NO: 6552 - RNA, 104 nt, Homo Sapiens
gcugucuauuaugagucugacuggcacagacaucugucaaggaagaaggauucuuugagcguauuugugucagucaacugcauauauggaccacaacagaaagc

SEQ ID NO: 6553 - RNA, 85 nt, Homo Sapiens
gcuguuggugaguauggagaucucugcccuugucagaggaaggcuuccucaucacaaggcagggcaggugucugugcccaagagc

SEQ ID NO: 6554 - RNA, 109 nt, Homo Sapiens
gcuuacaauugcugguaccugguagcauuuauuuucccucaaguaccuaguaaccuuaugaagguagggaggguagaugcucuaccacauuccuucagcuguauugagu

SEQ ID NO: 6555 - RNA, 108 nt, Homo Sapiens
gcuucacuuucaggggcaagguuugggaaauaagcugauaguaaagucauguaacacuuucugugcagguuaacauuucuggaccuugcuuuccuucucaguguaugc

SEQ ID NO: 6556 - RNA, 131 nt, Homo Sapiens
gcuucaucauccugguucaagcaguguuucuucucuaucaggccugguggcuguuguuuugggcuccccaaggcgagaggcggcccuggacaaguggguuggaagacacggugaccagagaagagggaagc

SEQ ID NO: 6557 - RNA, 74 nt, Homo Sapiens
gcuuccucaccaccuugugcacugcugcucccacaccacagugacuagcagcacauaaugguuugaauuaaagc

SEQ ID NO: 6558 - RNA, 72 nt, Homo Sapiens
gcuugaacccaggaaguggagguugcagggagccaugaucgcaccacugcacuccagccugggcaacagagc

SEQ ID NO: 6559 - RNA, 72 nt, Homo Sapiens
gcuugaacccaggagacugagguugcagugagcugagaucaugcaacugcacuccagccugggcaacacagc

SEQ ID NO: 6560 - RNA, 73 nt, Homo Sapiens
gcuugaacccaggaggcggagguugcagugagccaagauugcgccacugcacuccagccugggcaacaaaagc

SEQ ID NO: 6561 - RNA, 73 nt, Homo Sapiens
gcuugaacccaggagguggaggcugcaguaagccgagauugugccacugcacuccagccugggcaacaagagc

SEQ ID NO: 6562 - RNA, 73 nt, Homo Sapiens
gcuugaaccugggauguggagguuguagugagcugagauugggccauugcacuccagccugggcaacaagagc

SEQ ID NO: 6563 - RNA, 70 nt, Homo Sapiens
gcuugaacucgggguggagguugcagugagccaagaucgccccacugcacuccagccugggcaacaaugc

SEQ ID NO: 6564 - RNA, 72 nt, Homo Sapiens
gcuugaguccaggagguggagguugcagugaacagagauugugucacugcacucuagccugggcaacagagc

SEQ ID NO: 6565 - RNA, 77 nt, Homo Sapiens
gcuugcuggguuuacagauggcaaagaucuggcaaauuaaaaauagccuuaggccaaagaucaaacccaaggugggc

SEQ ID NO: 6566 - RNA, 89 nt, Homo Sapiens
gcuuggcaucaguuucauuuugcaaaacauggcuuugauaauugcaucagaucugcaaggcuguguaggcagaauucuuauugccaagu

SEQ ID NO: 6567 - RNA, 104 nt, Homo Sapiens
gcuugguaugcucagaagcugcuaaaguguguaugggcaggugugggggcaauuucuugguccuagcacuuccauauaucgacuuucuuuucuggcugcuaagu

SEQ ID NO: 6568 - RNA, 78 nt, Homo Sapiens
gcuuugaaagagauguggugugugaagacgaagaugccuuuuguuugucuuuggagaauauugcaacacuacaaaagu

SEQ ID NO: 6569 - RNA, 92 nt, Homo Sapiens
gcuuugaugaccagguuucauuagguaagaaggcccgauuaagcaacgguggcccaaauaaccucagugguucagacacuguuuuucaaagc

SEQ ID NO: 6570 - RNA, 109 nt, Homo Sapiens
gcuuuggccuuuaacaacucaguguuuuggucuaaucuucaagaggaauuugagguucacuugaauaaguuagacuaguuugagguggguguagcuagaggauugaagu

SEQ ID NO: 6571 - RNA, 99 nt, Homo Sapiens
ggaaaagaaccauggguuaggccuuuuugggaagagacaguucagcuuuugauguaaaacagcuguaccuucugagagagguagccccaugucuucauc

SEQ ID NO: 6572 - RNA, 77 nt, Homo Sapiens
ggaaaaugaguggaagaccuggcucccucucuucucucccguuaggcacaagacgguguaaauccuggucuuccucc

SEQ ID NO: 6573 - RNA, 77 nt, Homo Sapiens
ggaaacuggggccuucuuugaguacuagugaguaagacauuuugcaacagugcugaguaugaaaggcccuggucucu

SEQ ID NO: 6574 - RNA, 81 nt, Homo Sapiens
ggaaagaauaaaggcuuggacucagccuagguucaaguacugcaucuugaccuggccuguaggcaagucuuuucacuucuc

SEQ ID NO: 6575 - RNA, 118 nt, Homo Sapiens
ggaaauguggagaauuaaaaaggguagugaggcuggcauuuauagaaucuggcuuucuuguauuggguggaaagcuagaugaaaccaguuucucucagccuuuucucuccucaggucu

SEQ ID NO: 6576 - RNA, 75 nt, Homo Sapiens
ggaacagcagggcuagaaagccagagagacaggggcucuggcccuuucugaugcuguuuuuagcaccugcuuucc

SEQ ID NO: 6577 - RNA, 101 nt, Homo Sapiens
ggaacaguacacucacggcacccuggagaggagcggucacugguugcugagugaauuaaccgaauguuugcugcuuuucuccugcaacaguucauuauucc

SEQ ID NO: 6578 - RNA, 97 nt, Homo Sapiens
ggaacgagaauugcuugaacccaggaggcaaagguugcagugagucaagaucaugccacugcacuccugccugggugacagagugagaccuugucuc

SEQ ID NO: 6579 - RNA, 127 nt, Homo Sapiens
ggaagcaucccugcugcggacgcuuucacuucuaaagagucuugucugcuaauaagagugcccauggcccaggguggcagcagggggauuuagaaagggcaugaugauggcacuagcggcugcuuuc

SEQ ID NO: 6580 - RNA, 130 nt, Homo Sapiens
ggaagccuucccuuaccucagccugguugagggcccccugggcuguuuucacugguugaugguaucugaucccuuccagccugagguuccuggagggccaguccaggucugaggucugguucaugcuucc

SEQ ID NO: 6581 - RNA, 89 nt, Homo Sapiens
ggaagugaaagagggaagucucucuccccaucccuccucucaguuaccaugaggaugggcaguuucuucccuuuccguucuucacuuuc

SEQ ID NO: 6582 - RNA, 96 nt, Homo Sapiens
ggaauaagaaaggcaacguuuugcagcuuccaaauuucugaagaaacuaaucucagauuggcaguuaaagucaaaauguugccaaauauuuauucc

SEQ ID NO: 6583 - RNA, 92 nt, Homo Sapiens
ggaaucuugcuuuguagcccaggcuggagugcaguggugugaucuuggcucacggcaaccucugccucccgggucuaggcucaagcaguucu

SEQ ID NO: 6584 - RNA, 94 nt, Homo Sapiens
ggaaucuugcuuuguagcccaggcuggagugcaguggugugaucuuggcucacggcaaccucugccucccgggucuaggcucaagcaguucucc

SEQ ID NO: 6585 - RNA, 119 nt, Homo Sapiens
ggaauguucugaagaacugggugaucuugugaaaucuguggacccuacauuggcacuuaguguguaccuaagggcuaacgucccaaauaaagucauucagugcuuugcagaaacagguc

SEQ ID NO: 6586 - RNA, 128 nt, Homo Sapiens
ggacaucaaagaauaaauaagcugcucuaauugccaagaauucacaugugguuguaugcagcuuuacugggagacugaaguguaucugcaugugauucugcugugauggacacuuguaaguuugugcc

SEQ ID NO: 6587 - RNA, 128 nt, Homo Sapiens; identical to SEQ ID NO: 6586

SEQ ID NO: 6588 - RNA, 85 nt, Homo Sapiens
ggaccagacuauugugacauggagaauguagagaaauuauucaauguucaggaucaacaugaucuccucacucuaggauggaucc

SEQ ID NO: 6589 - RNA, 85 nt, Homo Sapiens
ggaccagacuauugugacauggagaauguagaggaauuauucaauguucaggaucaacaugaucuccucacucuaggauggaucc

SEQ ID NO: 6590 - RNA, 81 nt, Homo Sapiens
ggaccauugaggagguggggcagcagcaggacccccagaaccgaagccugugucucugcugucucaucccuucauucuucc

SEQ ID NO: 6591 - RNA, 86 nt, Homo Sapiens
ggaccuggagugcaucaggaucugaccagauaggaguuuuugccucgugucugggugcuacgauuuugugccguucucugaggucc

SEQ ID NO: 6592 - RNA, 101 nt, Homo Sapiens
ggacuacaggcacaugcaaccacaucuggcuaauuuucuugaguuuuaguagagacugggucucauuauguuguccaggcuggucccaagcuccugaguuc

SEQ ID NO: 6593 - RNA, 101 nt, Homo Sapiens
ggacuacaggcacaugcaaccacgucuggcuaauuuucuugaguuuuaguagagacugggucucguuauguuguccaggcuggucccgagcuccugaguuc

SEQ ID NO: 6594 - RNA, 101 nt, Homo Sapiens; identical to SEQ ID NO: 6593

SEQ ID NO: 6595 - RNA, 101 nt, Homo Sapiens; identical to SEQ ID NO: 6593

SEQ ID NO: 6596 - RNA, 101 nt, Homo Sapiens; identical to SEQ ID NO: 6593

SEQ ID NO: 6597 - RNA, 95 nt, Homo Sapiens
ggacugaaagagaacugggauggaggagaauuagaggauggugugguguuucccaagacauccccugaucuugcuaucccagcaucuccuagacc

SEQ ID NO: 6598 - RNA, 83 nt, Homo Sapiens
ggacugcuugagcccaggagguggagucuguagugagcugugauccugccacugcacuccagccugggcaacagagcaagacc

SEQ ID NO: 6599 - RNA, 83 nt, Homo Sapiens
ggacugcuugagcccaggagguugagguugcagugaaccaugaucaugucacugcacuccagccuggguaacagagugagacc

SEQ ID NO: 6600 - RNA, 93 nt, Homo Sapiens
ggagaagaggucuugcauaccagcacaguggauggggaauggugugaccucugucccugcucucuucucugcuggcuuaagggucuauucucc

SEQ ID NO: 6601 - RNA, 92 nt, Homo Sapiens
ggagaauagcuugaaccugggagguggagcuuacagugagccaccgagauugugucauugcacuccagccugggcaacaagagcaaaucucc

SEQ ID NO: 6602 - RNA, 88 nt, Homo Sapiens
ggagaaucacuagaaccuggaaggcgaagguugcagugagcggagaucgugccacugcacuccagccugggcaacagagcgauacucc

SEQ ID NO: 6603 - RNA, 87 nt, Homo Sapiens
ggagaaucacuuaagcccaggaauuugaggcugcagugagcaaugacugugccacuguacuucagccuggguaacagaggggacuuc

SEQ ID NO: 6604 - RNA, 88 nt, Homo Sapiens
ggagaaucacuugaacccaggaagaggagguugcaguaagccgagaucgugccacugcacuccagccugggcaacaaagugagauucc

SEQ ID NO: 6605 - RNA, 88 nt, Homo Sapiens
ggagaaucacuugaacccaggagacggagguugcagugagcccagaucgcgccacugcacuccagccugggcaacagaauaagacucc

SEQ ID NO: 6606 - RNA, 89 nt, Homo Sapiens
ggagaaucacuugaacccaggagacggaguuuguggugagccgagaucacaccauugcacuccagccugggcaacaacagugaaacucc

SEQ ID NO: 6607 - RNA, 88 nt, Homo Sapiens
ggagaaucacuugaacccaggaggcgaagguugcagugagcuaagaucgcaccacugcacuccagccugggcaacagagugacauucu

SEQ ID NO: 6608 - RNA, 88 nt, Homo Sapiens
ggagaaucacuugaacccaggagguggagguugcagugagccaagaucgugccacugcacuccagccugggugauagagcaagacucc

SEQ ID NO: 6609 - RNA, 89 nt, Homo Sapiens
ggagaaucacuugaacccaggagguggagguuguagugagcugagauugcaccacugcacuccagccugggcgauaagagugaaacucc

SEQ ID NO: 6610 - RNA, 93 nt, Homo Sapiens
ggagaaucacuugaacccaggaguuagagguugcagugagcccaaaaucacaccacuguacuccagccugccuggguaauagagugagauucc

SEQ ID NO: 6611 - RNA, 90 nt, Homo Sapiens
ggagaaucacuugaacccgggaaggcggagguugcagugagccgagaucgugccacugcacuccagccugggcaacaagagugagacucc

SEQ ID NO: 6612 - RNA, 88 nt, Homo Sapiens
ggagaaucacuugaacccgggagguggagcuugcagugagcugagaucacgccacugcacuccagccugggcaacagagccagacucc

SEQ ID NO: 6613 - RNA, 89 nt, Homo Sapiens
ggagaaucacuugaacccgggagguggagcuugcggugagccgagaucgcgccauugcacuccagccugggcaacaagagugaaacucc

SEQ ID NO: 6614 - RNA, 88 nt, Homo Sapiens
ggagaaucacuugaacccgggagguggagguugcagugagcugagauugcgccacugcacuccagccugggcaacagagcgagacucc

SEQ ID NO: 6615 - RNA, 91 nt, Homo Sapiens
ggagaaucacuugaaccugggaggcagagguuguugcagugagccgagauugcaccacugcacuccagccugggugacagagugagacucc

SEQ ID NO: 6616 - RNA, 88 nt, Homo Sapiens
ggagaaucacuugaaccugggaggcggagguugcagugagccgagauugagccauugcacuccagccuggacaucagggcgagacucc

SEQ ID NO: 6617 - RNA, 88 nt, Homo Sapiens
ggagaaucacuugaacucgagaggcggagguugcagugagcugagaucccgccacugcacuccagccugggugacagagcgagacucc

SEQ ID NO: 6618 - RNA, 87 nt, Homo Sapiens
ggagaaucacuugaacucgggaggggaggcugcagugagccaagaucacacaccacugcacuccagccugggcaacaaagugagacc

SEQ ID NO: 6619 - RNA, 88 nt, Homo Sapiens
ggagaaucacuugaacucgggaggggaggcugcagugagccaagaucacacaccacugcacuccagccugggcaacaaagugagaccc

SEQ ID NO: 6620 - RNA, 88 nt, Homo Sapiens
ggagaaucacuugagccccggaggcagggguugcagugagcugagauugugccacugcacuccagccugggcaacagagugaaacucc

SEQ ID NO: 6621 - RNA, 89 nt, Homo Sapiens
ggagaaucacuugagcccuggaggcagaagaugcagugagccugggucaugccacugcacuccagccugggcaacaagagugagacucc

SEQ ID NO: 6622 - RNA, 88 nt, Homo Sapiens
ggagaaucacuuuaaccagagaguuggagguugcagggagccgagaucgcaccacugcacuccagccugggugacaaagcgagacucc

SEQ ID NO: 6623 - RNA, 89 nt, Homo Sapiens
ggagaaucauuugaacccaggagguggaaguugcagugagcucagaucgcaccauugcacuccagccuggguaacaagaaugaaacucc

SEQ ID NO: 6624 - RNA, 88 nt, Homo Sapiens
ggagaaucauuugagcccaggaagcagagguugcagugagccaagaucacgccacugcacuccagccugggcaacagagugagacucc

SEQ ID NO: 6625 - RNA, 88 nt, Homo Sapiens
ggagaaucgcuugaacccagaaggcagagguugcagugagccaagauggugccacugcacuccagccugggcaacagagcgagacucu

SEQ ID NO: 6626 - RNA, 88 nt, Homo Sapiens
ggagaaucgcuugaacccaggaaguggagguugcagggagccaugaucgcaccacugcacuccagccugggcaacagagcaagacucc

SEQ ID NO: 6627 - RNA, 89 nt, Homo Sapiens
ggagaaucgcuugaacccaggaaguggagguugcagugagccaauauugugccauugcacuccagcuugggcaacaagagcgaaacucc

SEQ ID NO: 6628 - RNA, 88 nt, Homo Sapiens
ggagaaucgcuugaacccaggagauggagguugcagugagcugagaucacgccacugcacuccagccugggcaacagagugagacucc

SEQ ID NO: 6629 - RNA, 88 nt, Homo Sapiens
ggagaaucgcuugaacccaggaggcagagguugcagugagccaagaucaugccacugcacuccagccugggcaacagagugagacucc

SEQ ID NO: 6630 - RNA, 88 nt, Homo Sapiens
ggagaaucgcuugaacccaggaggcggagguugcagugagcugagauugcacuauugcacuccagucugggugacagagugagacucc

SEQ ID NO: 6631 - RNA, 95 nt, Homo Sapiens
ggagaaucgcuugaacccaggagguggagagguugcagggagccgagaucacacacaccacugcacuccagccugggcaacaagagcaaaacucc

SEQ ID NO: 6632 - RNA, 89 nt, Homo Sapiens
ggagaaucgcuugaacccaggagguggaggcuguggugagcugagauugcgccauugcacuccagccugggcaacaagagcgaaacucc

SEQ ID NO: 6633 - RNA, 89 nt, Homo Sapiens
ggagaaucgcuugaacccaggagguggagguugcagugagccgagaucgcgccauugcacuccagccugggcaacaagagcagaacucc

SEQ ID NO: 6634 - RNA, 88 nt, Homo Sapiens
ggagaaucgcuugaacccaggagguggagguugcagugagcugaggucacaccacugcacuccagccugggcaacagagcgagacucc

SEQ ID NO: 6635 - RNA, 88 nt, Homo Sapiens; identical to SEQ ID NO: 6634

SEQ ID NO: 6636 - RNA, 88 nt, Homo Sapiens; identical to SEQ ID NO: 6634

SEQ ID NO: 6637 - RNA, 88 nt, Homo Sapiens; identical to SEQ ID NO: 6634

SEQ ID NO: 6638 - RNA, 88 nt, Homo Sapiens; identical to SEQ ID NO: 6634

SEQ ID NO: 6639 - RNA, 88 nt, Homo Sapiens
ggagaaucgcuugaacccaggagguggagguuguggcgagcugagaucaugccacugcacuccagccugggcaacagagugagacucc

SEQ ID NO: 6640 - RNA, 88 nt, Homo Sapiens
ggagaaucgcuugaacccaggagguggagguuguggugagccaagaucgugacauugcacuccagccugggcaacagagcgagauucc

SEQ ID NO: 6641 - RNA, 88 nt, Homo Sapiens
ggagaaucgcuugaacccagguggcaaggcuugcagugagcugagaucgcacuacugcacuccagccugggcaacagagcgagacucc

SEQ ID NO: 6642 - RNA, 88 nt, Homo Sapiens
ggagaaucgcuugaacccgagagguggagguugcagugagccaagaucacaucacugcacuccagccugggugacagagcaagacucc

SEQ ID NO: 6643 - RNA, 88 nt, Homo Sapiens
ggagaaucgcuugaacccggcaggcagaaguugcagugagccgagaucacgccauugcacuucagccugggugacagagggggacucc

SEQ ID NO: 6644 - RNA, 89 nt, Homo Sapiens
ggagaaucgcuugaacccgggaaguggagguugcagugagccgagaucuugccauuguucuccagccugggcgacaagagugaaacucc

SEQ ID NO: 6645 - RNA, 89 nt, Homo Sapiens
ggagaaucgcuugaacccgggagccggagguugcagugagucgagaucaugccacugcacuccagccugggcaacaagagugagacucc

SEQ ID NO: 6646 - RNA, 89 nt, Homo Sapiens
ggagaaucgcuugaacccgggaggcagagguugcagugagaugagaucacaccacugcacuccagccugggcaacaagagcgaaacucc

SEQ ID NO: 6647 - RNA, 88 nt, Homo Sapiens
ggagaaucgcuugaacccgggaggcagagguugcagugagccgagaucgcacuacugcacuccagccugggcaacagagugagacucc

SEQ ID NO: 6648 - RNA, 88 nt, Homo Sapiens; identical to SEQ ID NO: 6647

SEQ ID NO: 6649 - RNA, 90 nt, Homo Sapiens
ggagaaucgcuugaacccgggaggcggaggugguggugagccgagauugugccacugcacuccagccugggcaacaagagcaaaaacucc

SEQ ID NO: 6650 - RNA, 89 nt, Homo Sapiens
ggagaaucgcuugaacccgggaggcggagguuguggugagccaagauugcgccauugcacuccagccugggcaacaacagcgaaacucu

SEQ ID NO: 6651 - RNA, 88 nt, Homo Sapiens
ggagaaucgcuugaacccgggagguggagguuacggugagugagaucgcgccauugcacuccagccugggcaacaagagcgaaacucc

SEQ ID NO: 6652 - RNA, 91 nt, Homo Sapiens
ggagaaucgcuugaacccgggggguggagguaguggugagccgagcuugcacaccauugcacuccagccugggcaacaagagagaaacucc

SEQ ID NO: 6653 - RNA, 89 nt, Homo Sapiens
ggagaaucgcuugaacccuggaggcagagguugcggugagccaagaucgugccauugcacuccagccugggcaacaagagugaaacucc

SEQ ID NO: 6654 - RNA, 89 nt, Homo Sapiens
ggagaaucgcuugaaccugagaggcggagguugcggggagccaagaucgcaccauugcacuccagccugggcaacaagagcgaaacucc

SEQ ID NO: 6655 - RNA, 89 nt, Homo Sapiens
ggagaaucgcuugaaccugggaggcggagguugcggugagccgagaucgcgccauugcacuccagccugggcaacaaaaccgaaacucc

SEQ ID NO: 6656 - RNA, 88 nt, Homo Sapiens
ggagaaucgcuugaaccugggagguggagguuguggugagcugagauugugccacugcacuccagccugggcaacagaucgagacucc

SEQ ID NO: 6657 - RNA, 89 nt, Homo Sapiens
ggagaaucgcuugaaccuggggggcggacguugcagugagccaagaucgcaccauugcacuccagccugggcaacaagagcaaaucucc

SEQ ID NO: 6658 - RNA, 87 nt, Homo Sapiens
ggagaaucgcuugaacucgggaggggaggcugcagugagccaagaucacacaccacugcacuccagccugggcaacaaagugagacc

SEQ ID NO: 6659 - RNA, 87 nt, Homo Sapiens; identical to SEQ ID NO: 6658

SEQ ID NO: 6660 - RNA, 87 nt, Homo Sapiens; identical to SEQ ID NO: 6658

SEQ ID NO: 6661 - RNA, 87 nt, Homo Sapiens; identical to SEQ ID NO: 6658

SEQ ID NO: 6662 - RNA, 87 nt, Homo Sapiens; identical to SEQ ID NO: 6658

SEQ ID NO: 6663 - RNA, 88 nt, Homo Sapiens
ggagaaucgcuugaacucgggaggggaggcugcagugagccaagaucacacaccacugcacuccagccugggcaacaaagugagaccc

SEQ ID NO: 6664 - RNA, 81 nt, Homo Sapiens
ggagaaucgcuugaaucagggaguuggagguugcagugagcugaggucaccugcauuccagccugcugacagcgagacucc

SEQ ID NO: 6665 - RNA, 82 nt, Homo Sapiens
ggagaaucgcuugaauccaggagguugcagugagcugagaucacgccacugcacuccagccugggugacagagcaagacucc

SEQ ID NO: 6666 - RNA, 85 nt, Homo Sapiens
ggagaaucgcuugaaucugggaggcggagguugcagugagcugagaucgcaccacugcacuccagccuguugacagcgagauucc

SEQ ID NO: 6667 - RNA, 89 nt, Homo Sapiens
ggagaaucucuugaacccgggagguggagguuggggugagccgagaccgcgccauugcacuccagccugggcaacaagagugagacucc

SEQ ID NO: 6668 - RNA, 88 nt, Homo Sapiens
ggagaauggcaugaacccgggagguggagcuugcagugagcagagaucacgccacugcacuccagccugggcaacagagcgagacucc

SEQ ID NO: 6669 - RNA, 88 nt, Homo Sapiens; identical to SEQ ID NO: 6668

SEQ ID NO: 6670 - RNA, 88 nt, Homo Sapiens
ggagaauggcaugaaccugggagguggagcuugcagugagcccagauugcaacacugcacuccagccugggcaacagagccagacucu

SEQ ID NO: 6671 - RNA, 88 nt, Homo Sapiens
ggagaauggcgugaacccaggagguggagcuugcagugagccgagaucgcgccacugcacuccagccugggcaacagagcaagacucc

SEQ ID NO: 6672 - RNA, 88 nt, Homo Sapiens
ggagaauggcgugaacccgggaggcggagguugcagugagccgagauugugccacugcacuccagccugggcaacagagcgagacucc

SEQ ID NO: 6673 - RNA, 89 nt, Homo Sapiens
ggagaaugggccugaacccgggaggcggacguugcagugagccgagauugcaccacugcacuccagccugggcaacagagcgagacucc

SEQ ID NO: 6674 - RNA, 72 nt, Homo Sapiens
ggagaauugccugaacccagcaggcagagguugcaccacugcacuccagccugggcaacagagcaagacucc

SEQ ID NO: 6675 - RNA, 88 nt, Homo Sapiens
ggagaauugccugaacucaggaagcggaggucgcaguaagcugagaucaugccacugcacuccagccugggcaacagagcgagacucu

SEQ ID NO: 6676 - RNA, 88 nt, Homo Sapiens
ggagaauugcuugaacccaagagguggaggcugcagugagcugagaucaugccacugcacuccagccugggcaacagagcaagacucc

SEQ ID NO: 6677 - RNA, 88 nt, Homo Sapiens
ggagaauugcuugaacccaagagguggagguugcagugagccacgauugugccauugcacuccagccugggugacagagugagacucc

SEQ ID NO: 6678 - RNA, 88 nt, Homo Sapiens; identical to SEQ ID NO: 6677

SEQ ID NO: 6679 - RNA, 88 nt, Homo Sapiens; identical to SEQ ID NO: 6677

SEQ ID NO: 6680 - RNA, 88 nt, Homo Sapiens; identical to SEQ ID NO: 6677

SEQ ID NO: 6681 - RNA, 87 nt, Homo Sapiens
ggagaauugcuugaacccaggaagcagagguugcggugagcugaaucaugccacugcacuccagccugggcaacagagcagcacuuc

SEQ ID NO: 6682 - RNA, 89 nt, Homo Sapiens
ggagaauugcuugaacccaggacguggagguugccaugagcugagaucacgccauugcacuccagccugggcaacaagagcgaaacucc

SEQ ID NO: 6683 - RNA, 88 nt, Homo Sapiens
ggagaauugcuugaacccaggaggcagaagcugcagugagccaagauagugccacugcacuccagccugggcaacagagcgagacucc

SEQ ID NO: 6684 - RNA, 88 nt, Homo Sapiens
ggagaauugcuugaacccaggaggcggagguugcagugagccgagauagcaccacugcacuccagccugggcaacagagugagacucc

SEQ ID NO: 6685 - RNA, 89 nt, Homo Sapiens
ggagaauugcuugaacccaggagguggagguugcagugagccgagauugagccacugcacuccagccugggcaacaagagcaaaacucc

SEQ ID NO: 6686 - RNA, 88 nt, Homo Sapiens
ggagaauugcuugaacccaggagguggagguuucagugagccaagauuguaccacugcacuccagccugggcaacagagcgagacucc

SEQ ID NO: 6687 - RNA, 83 nt, Homo Sapiens
ggagaauugcuugaacccaggagguugcagugagccgagguugcgccauugcacuccagccugggcaacaagagcgaaacucc

SEQ ID NO: 6688 - RNA, 87 nt, Homo Sapiens
ggagaauugcuugaacccgggagguggagguugcagugagccgagaucgcccacugcacuccagccugggcaacagagcaagacucu

SEQ ID NO: 6689 - RNA, 88 nt, Homo Sapiens
ggagaauugcuugaacccgggagguggagguugcagugagccgagaucgcgccauugcacuccagccugggcaacagagcaagacucu

SEQ ID NO: 6690 - RNA, 89 nt, Homo Sapiens
ggagaauugcuugaacccggguggcggagguuguggugagugaagauugcacuauugcacuccagccugggcaacaagagugaaacucc

SEQ ID NO: 6691 - RNA, 88 nt, Homo Sapiens
ggagaauugcuugaacccuggaggcagagguugcagugagccgagaucgugccacugcacuccagccugggcaacagugcgagacucc

SEQ ID NO: 6692 - RNA, 86 nt, Homo Sapiens
ggagaauugcuugaaccuggaggcggagguugcagugagccgagauugugccacugcacuccagcccggcaacagagcaagacucc

SEQ ID NO: 6693 - RNA, 87 nt, Homo Sapiens
ggagaauugcuugaaccugggaaguggagguugcagugagccgagacugagcacugcacuccagccugggcaacagagugagacucu

SEQ ID NO: 6694 - RNA, 88 nt, Homo Sapiens
ggagaauugcuugaaccugggaggcagagguugcagugagcugagaucacgccauugcacuccagccugggcaacagagcgagaaucc

SEQ ID NO: 6695 - RNA, 88 nt, Homo Sapiens
ggagaauugcuugaaccugggaggcagugguugcagugagccgagauugugccacugcacuccacccucagcaacagagcaaaacucc

SEQ ID NO: 6696 - RNA, 88 nt, Homo Sapiens
ggagaauugcuugaaccugggaggugaagguugcagugagcugagaccaugccacugcacuccagccugggcaacagagcaaaacucc

SEQ ID NO: 6697 - RNA, 88 nt, Homo Sapiens
ggagaauugcuugaacgccggggucggagguugcagugagccaugaucgcgccacugcacuccagccugggcaacagagcgagacucu

SEQ ID NO: 6698 - RNA, 88 nt, Homo Sapiens
ggagaauugcuugaacucaggaggcggaaguugcagugagcugagaucgcaccacugcacuccagccugggcaacagagugagacucc

SEQ ID NO: 6699 - RNA, 88 nt, Homo Sapiens
ggagaauugcuugaacucgggaggcggauguugcagugagccaauaucgcaccacugcacuccagccugggcaacagagcaagacucc

SEQ ID NO: 6700 - RNA, 88 nt, Homo Sapiens
ggagaauugcuugaauccaggaggcagagguugcagugagcugagaucaugccacugcacuccagccugggugacagagugacacucc

SEQ ID NO: 6701 - RNA, 88 nt, Homo Sapiens
ggagaauugcuugcacccaggaggcagagguuguggugagcugagaucgucccauugcacuccagccugggugacagggcgaaacucc

SEQ ID NO: 6702 - RNA, 89 nt, Homo Sapiens
ggagaauuguuugaacccacauggcggagacugcggugagcugauaccgcgucauugcacuccagccugggcaacaagagcaaaacucc

SEQ ID NO: 6703 - RNA, 88 nt, Homo Sapiens
ggagaauuucuugaacccaggagguggagguugcagugagccgagauugcgccacugcacuccagccugggcaacagaacaagacucc

SEQ ID NO: 6704 - RNA, 112 nt, Homo Sapiens
ggagacaugauguagcagaugaugggacugucuuacauaacuggaucuuuuagaacuaucgaagauuaaguaguaaaaugguauaaaaaguuucuugacaauguuauuuucc

SEQ ID NO: 6705 - RNA, 98 nt, Homo Sapiens
ggagacccaggacccgggagagagguagaggggagcagagacagccaccagcuucuaucuucugcucuaagcacauucuuucacgaguuuaaguuucc

SEQ ID NO: 6706 - RNA, 106 nt, Homo Sapiens
ggagacgaacacauacacagaagauucagacacacuugcaauguauugcuggggauucuccagcauuggcaugauggagaggguggagaaucauuugaccgccucc

SEQ ID NO: 6707 - RNA, 103 nt, Homo Sapiens
ggagaggcauugugagggagagaggugucaggaaugaaagaaugucuuaaaauucuaagcagucuuucuucuucuucucuuuauuaacagcaauuaacucucu

SEQ ID NO: 6708 - RNA, 97 nt, Homo Sapiens
ggagaugguuuccaguucaccgucaacccaaaagcucucuucaggucauggcaaacagaccagggcuguggguguggcugugcuuggcacugacucc

SEQ ID NO: 6709 - RNA, 103 nt, Homo Sapiens
ggaggaccuggccaaaguggguggugcagggguggucuuaggagggcuuuccugaaggaguggccaggguucacccaucuuuccacccacggacccauccucu

SEQ ID NO: 6710 - RNA, 90 nt, Homo Sapiens
ggaggaucacgugagcccaggaggugaaggcuacagugaagugagaucaugcaacuguacuucagccugggcaacagagcaagauucucu

SEQ ID NO: 6711 - RNA, 88 nt, Homo Sapiens
ggaggaucacuugaaccugggagauggaggucucagugagcugagauugcgucacugcacuccagccugggcaacaaaaugagacucc

SEQ ID NO: 6712 - RNA, 107 nt, Homo Sapiens
ggaggcugagaugggagguucacuugaacccaggagguggaggcuguggugagccaacauccugccacugcacuccagccugggcaacagagccaaacucugacucc

SEQ ID NO: 6713 - RNA, 86 nt, Homo Sapiens
ggaggggaggauacaagaggaaugauaaauggcaaggaaaaccacucacucuuaaugcuuuuugucauacucauguccucuugucc

SEQ ID NO: 6714 - RNA, 81 nt, Homo Sapiens
ggaggggccaggaggaaaugaugagucuuagugaucuggaaacauuccagacuaauuuauuaucuucucuuuuuucccuuc

SEQ ID NO: 6715 - RNA, 56 nt, Homo Sapiens
ggaggugggaugugugugcuacuggcaucuaguggcugcuaaacauccuacacugc

SEQ ID NO: 6716 - RNA, 88 nt, Homo Sapiens
ggaguaucgcuugaaccugcgaggcggagguugcagugagccgggaucgcaccacugcacuccagccugggcaacagagugagacucc

SEQ ID NO: 6717 - RNA, 105 nt, Homo Sapiens
ggauacauaguggucacuuccauuuaagauguuugcauuucagcacuuuuauaauucaaauauggugcugucccuugagacucuuguugagagccacauguaucu

SEQ ID NO: 6718 - RNA, 83 nt, Homo Sapiens
ggaucacuugagcccaggagguugaggcugcagugagccauguuccugccacugcacuccagccugggcaacagagugagacc

SEQ ID NO: 6719 - RNA, 83 nt, Homo Sapiens
ggaucgcuugagcccaggaguucgaggcugcagugagcugugaucacaccacugcacuccagccugggcaacagagcgagacc

SEQ ID NO: 6720 - RNA, 83 nt, Homo Sapiens
ggauggcuugaguccaggagguggagguugcagugaacagagauugugucacugcacucuagccugggcaacagagcgagacc

SEQ ID NO: 6721 - RNA, 95 nt, Homo Sapiens
ggaugguuuggggaagagaaugugcauggaucgcucagaacugacccagaggcaaugaguauuugugugccauguggauucucuccaaaaugucc

SEQ ID NO: 6722 - RNA, 103 nt, Homo Sapiens
ggauuagaugauggugacagcaguagcagcaggagcagguaacauucauuuagaguugagaugugccacacccugcucuaaaugcuuuauggauaucaagucc

SEQ ID NO: 6723 - RNA, 85 nt, Homo Sapiens
ggauuaguucuggagagagcagguugcuaagaagaaucuggcuucuucagucagcgcucuugcuuccuaucucuccaugugaucu

SEQ ID NO: 6724 - RNA, 64 nt, Homo Sapiens
ggauuuggcaaagaaggcaguacaguuaauccuggcugcaacugcuggaaaauuugcuacaccc

SEQ ID NO: 6725 - RNA, 131 nt, Homo Sapiens
ggcaagauccucgcuccaaccguggcccguguucucuccuuuuguccccauagugugacuccgccaggaacuuggaauggcugaagacugugaaugagagucaugggucuguggaacgcucaucccugacc

SEQ ID NO: 6726 - RNA, 106 nt, Homo Sapiens
ggcacuuggaaccgucuuggggaauauagcuugguaauugaacugcuuaagcuuauuauuaauauuuaagcuauaguuccaggcccauuccagaggucccccagcc

SEQ ID NO: 6727 - RNA, 81 nt, Homo Sapiens
ggcagaauggaagugauuucuccuaaugaaaaugaagugcucuuuugaguauuucuuguuuuauugagauuccuaucugcc

SEQ ID NO: 6728 - RNA, 89 nt, Homo Sapiens
ggcagagcgcugccucucugcaggccgugugcuuugcucgguugaucuugcagagccuaagacacaggcccagagaggcagugaucgcc

SEQ ID NO: 6729 - RNA, 103 nt, Homo Sapiens
ggcagaggagggcucacuuuucaaaguuccaaauagggcaaaauguguguuucccuaggaaguauuuuuuaaaaacauuuuugagauagagucuugcucuguc

SEQ ID NO: 6730 - RNA, 90 nt, Homo Sapiens
ggcaggaaaauuccuucaccugggagguggagguugcagugagccaagauugcaccacuacacuccuaggcaauggagugagaccuuguc

SEQ ID NO: 6731 - RNA, 93 nt, Homo Sapiens
ggcaggagaaucaccugaacccggguggcagagguugcagggaggcgagaucgugccacugcacuccagccugggcaacagagugagacuguc

SEQ ID NO: 6732 - RNA, 96 nt, Homo Sapiens
ggcaggagaaucacuugaacccaggaggcagagguugcagugagccaagaucaugccacugcacuccagccugggcaacaagaaugaaacucuguc

SEQ ID NO: 6733 - RNA, 96 nt, Homo Sapiens
ggcaggagaaucgcuugaacccgggaggcggagguuguggugagccaagauugcgccauugcacuccagccugggcaacaacagcgaaacucuguc

SEQ ID NO: 6734 - RNA, 95 nt, Homo Sapiens
ggcaggagaaucgcuugaaccugggagacagagguugcagugagccaagaucgugucacugcacuccagccugggcaacagagugagacucuguc

SEQ ID NO: 6735 - RNA, 103 nt, Homo Sapiens
ggcaggagaauugcuugaacacaggaggcagagauugcagugagucaagaucaugccacugcacuccagcacuccagccuaagugacagagcaagauccuguu

SEQ ID NO: 6736 - RNA, 95 nt, Homo Sapiens
ggcaggagaauugcuugaaccugggagguggagguugcagugagccgagaucgcaccacugcacuccagccugggcaacagagugaggcucuguc

SEQ ID NO: 6737 - RNA, 130 nt, Homo Sapiens
ggcagggaggugacgagguaggggcagagcggauggaagccggagaucccagguucccggaauacuccggcuggggccuucgggcuucuccuguccccucccuacccccgugccucggguuucucccucc

SEQ ID NO: 6738 - RNA, 79 nt, Homo Sapiens
ggcaucuguaaucccagcuacucgggaggcugaggcacgagaauugcuugagccugggagguggagauugcagugaguc

SEQ ID NO: 6739 - RNA, 95 nt, Homo Sapiens
ggcaugagaaucgcuugaacccgggaggcggaggcugcagugagccaagaucgugccacugcacuccagccugggcaaccgagugagacucuguc

SEQ ID NO: 6740 - RNA, 65 nt, Homo Sapiens
ggcauggcagagccuugauuuguaauguuugcuaauuuacgugguacaagugcuccaguacggcc

SEQ ID NO: 6741 - RNA, 82 nt, Homo Sapiens
ggcaugguggugcucugauagcccuagcuacucaggaggcugagccuaguaguuagaggcugcagugaacuaugauugugcc

SEQ ID NO: 6742 - RNA, 90 nt, Homo Sapiens
ggcauuagauucucauaaggagcacacaaccuagauugcuagcaggcacaguucacaauaggguucguucuccugugagaauggcaugcc

SEQ ID NO: 6743 - RNA, 108 nt, Homo Sapiens
ggcauuagguuucagucacagccaagcaaguguggacagugaguaaugucugaagauuccauagcuugaucacagcuacuuuuguccugcugucugaacuccauuguc

SEQ ID NO: 6744 - RNA, 78 nt, Homo Sapiens
ggccaccugcugccuauucccuggcacuucauucuucugauaauggaguaugagagagaaugggacaugagguggacc

SEQ ID NO: 6745 - RNA, 81 nt, Homo Sapiens
ggccacuuccaccuuccagggcauaggugaccccuguggaaaacaaguaccccuggaacauccuagaaguggagguggacc

SEQ ID NO: 6746 - RNA, 85 nt, Homo Sapiens
ggccaggacucuugcagaacugagaccugggagcuccucccucaccaggaagggacccgaggcaggcggcgggggucucugagcc

SEQ ID NO: 6747 - RNA, 82 nt, Homo Sapiens
ggccaugccuuugucacccuaaauacugcacggccaugccuuugucaggcaggcugagugacugggaguuaggaggguggcc

SEQ ID NO: 6748 - RNA, 113 nt, Homo Sapiens
ggcccagcguggcuccugaccuggaggauaacaaugauaauggaagugcuguuaaaaguaagaaugacuaugaguuauugaguuuuucaucugcucaggcaccgugcugggcc

SEQ ID NO: 6749 - RNA, 79 nt, Homo Sapiens
ggccucccaaagugcugagauuacaggcaugagccacugcaccuggcccuugccucuauuucaaagcuacuuuggugcc

SEQ ID NO: 6750 - RNA, 114 nt, Homo Sapiens
ggccuccucccagcgucacggaaugcuguccugaucccuagcauuuacucacaugcugugcuuagugcuugaccaugugguggcagauucugugauguguaagacgugguugcc

SEQ ID NO: 6751 - RNA, 86 nt, Homo Sapiens
ggccuucucucugaguuaagcaaagagaggaagaauggcaaauaguuugagucuucccaaaucuuuuuagcauuugagaaaaggcu

SEQ ID NO: 6752 - RNA, 93 nt, Homo Sapiens
ggcgcuggugucaaacaguuaugugaugcuuugaagcacccucacuguagaugagagugucuugcacugcaaacauagccgaucacccgugcc

SEQ ID NO: 6753 - RNA, 95 nt, Homo Sapiens
ggcgggagaauugcuugaacccgggagguggagguugcagugagccgagaucgcgccauugcacuccagccugggcaacagagcaagacucuguc

SEQ ID NO: 6754 - RNA, 96 nt, Homo Sapiens
ggcguaucagguuucagaggaugcggcugggaacgggaguagaggugaggggucguugcaucugucgcgguguguaucuuuuggggguucagcgcc

SEQ ID NO: 6755 - RNA, 73 nt, Homo Sapiens
ggcgucacugcccugaugggcgguugggaaggcaaaaccugcccugaaaagccuuuggguagugauucuagcc

SEQ ID NO: 6756 - RNA, 91 nt, Homo Sapiens
ggcgucuugcucuauuggcaggcuggagugcaguggugcgaucucagcucacugcaacccccgccucccagauucaagcaauucuccugcc

SEQ ID NO: 6757 - RNA, 101 nt, Homo Sapiens
ggcgugagggaaagcaugaaaaauccaggauaaaaucaucaucagggaaacuccuaugaugcuggaacuggacaacaguguuuuagaucccuagucaugcc

SEQ ID NO: 6758 - RNA, 106 nt, Homo Sapiens
ggcuaagaguaacaggugcuggagccagacuuccuggguucauauccugguucuaccaauuuaccagcugugugaacuuaggaaaauuccucuccgccucuuaguu

SEQ ID NO: 6759 - RNA, 101 nt, Homo Sapiens
ggcuaagucaugagaauugcuugaacccaggcaucggagguugcagugagccgagauugcaccaaugcacuccagccugggcgacagagcgagacuccguc

SEQ ID NO: 6760 - RNA, 99 nt, Homo Sapiens
ggcuccggugguugcagucagauggcagcuggagguggagcaaccugaugucgugguuuugcauccacgacagcuucucucagacaagugauccuagcc

SEQ ID NO: 6761 - RNA, 77 nt, Homo Sapiens
ggcugagaccacccuugccugcccccuucuuucugccuuaagaauguccuuuuaggcugggcaugguggcucacgcc

SEQ ID NO: 6762 - RNA, 108 nt, Homo Sapiens
ggcugagggggaggaucacuugagcccaggaguucaaggcugcagugagccaugauugcgccacugcacuccagccugggcaacagagcaagacccugccccgccgcc

SEQ ID NO: 6763 - RNA, 80 nt, Homo Sapiens
ggcugaugugcucuguggcaucugucacagguuuuaauugaaggucagcaguggcagguaagccaccagcaucaucagcu

SEQ ID NO: 6764 - RNA, 90 nt, Homo Sapiens
ggcugggaacugugacucguacuuguaauccuagugcuuugagaggcugaggcaggaggauugcuugagaccaggaguuugagaccagcc

SEQ ID NO: 6765 - RNA, 88 nt, Homo Sapiens
ggcugggacugaggucauguucugucagguuccaaagagcgccaggaagacucugagaccacagagcacggccugcuuucucccagcc

SEQ ID NO: 6766 - RNA, 105 nt, Homo Sapiens
ggcuggggaaguuacuuaccuacuccgugucucaguuuuacuuaucucuaaaagggguagaguaacagcacucacuggaguggagugugguuaugccucccagcc

SEQ ID NO: 6767 - RNA, 84 nt, Homo Sapiens
ggcuguggcuggauucaaguaauccaggauaggcuguuuccaucugugaggccuauucuugauuacuuguuucuggaggcagcu

SEQ ID NO: 6768 - RNA, 92 nt, Homo Sapiens
ggcuuccccagucauauauucucagauucaaaggaacaaaguggccccagucagccuuucccagaaaccugugagugugguggcuggaagcc

SEQ ID NO: 6769 - RNA, 76 nt, Homo Sapiens
ggcuuccucaccaccuugugcacugcugcucccacaccacagugacuagcagcacauaaugguuugaauuaaagcu

SEQ ID NO: 6770 - RNA, 59 nt, Homo Sapiens
ggcuugggccgaccccagagagagcccaucaccuucuuuuugggguuuggggcuuggcc

SEQ ID NO: 6771 - RNA, 86 nt, Homo Sapiens
ggcuuuaggaaucgccuggcucuacccucucacuucauggcuacagauacuugugcccugagagagcaagugaauuucccaaagcc

SEQ ID NO: 6772 - RNA, 81 nt, Homo Sapiens
ggcuuuaucucuugccuugaccuccuacauuaucaacaaagugagaguuuaagaucuccugggcaggagauuucagaagcc

SEQ ID NO: 6773 - RNA, 76 nt, Homo Sapiens
gggaaagcagaagguuggggcuggaggucugcuggcaggcaggcagacauuuggagccaacuuuccugcucagccc

SEQ ID NO: 6774 - RNA, 77 nt, Homo Sapiens
gggaaaggcccaggagggggagaaaggcagacucagccagggaugggugaggguuucccugucccaaagcaagaccc

SEQ ID NO: 6775 - RNA, 106 nt, Homo Sapiens
gggaagaacuaccaaucuagggcacacgucucucugaauuguugauuaugcgcuuuaugaagagauuuuucaaucucgugugcuuuacuuugugugguuuagaccc

SEQ ID NO: 6776 - RNA, 78 nt, Homo Sapiens
gggaaggcaguagguuguauaguuaucuuccgaggggcaacaucacugcccugaaaccacacaaccuacuaccucacc

SEQ ID NO: 6777 - RNA, 90 nt, Homo Sapiens
gggacaaggcaaaugagagaggaaggccguagggaagggcuucucuccuaccucccacgucuuuaucuguccaaauccuugcuauuuccc

SEQ ID NO: 6778 - RNA, 101 nt, Homo Sapiens
gggacagcauccuuuuuuggcauuuguuuguugcggguggggagaggauugaacccuuaaccucaccucgcucgcaaguaucaagaaagggaaccugaccc

SEQ ID NO: 6779 - RNA, 129 nt, Homo Sapiens
gggacaucaaagaauaaauaagcugcucuaauugccaagaauucacaugugguuguaugcagcauuacugggaaauugaaguguaucugcaugugauucugcugugauggacacuuguaaguuuguucc

SEQ ID NO: 6780 - RNA, 84 nt, Homo Sapiens
gggaccguuagcugaaaugcuguugauuuuaguggcugugagcacacauaaggauacaggucauuucccuuauaauuagguccc

SEQ ID NO: 6781 - RNA, 77 nt, Homo Sapiens
gggacugcugucugcugucuacacuacacacuacuacacugcugucugcugugugugauaaggacacagauaguccu

SEQ ID NO: 6782 - RNA, 89 nt, Homo Sapiens
gggacuuaacugagaggaucugaguagcagacacccuaagagcaugucauugucuucucaccaguuacucuccaguuggcuagaguccc

SEQ ID NO: 6783 - RNA, 100 nt, Homo Sapiens
gggagacccaggacccgggagagagguagaggggagcagagacagccaccagcuucuaucuucugcucuaagcacauucuuucacgaguuuaaguuuccu

SEQ ID NO: 6784 - RNA, 88 nt, Homo Sapiens
gggagacuugcuugaacccaggaggcggagggugcagugagucgacaucaugccacugcacuccagccugggcaacagagcaagaccc

SEQ ID NO: 6785 - RNA, 105 nt, Homo Sapiens
gggagaggcauugugagggagagaggugucaggaaugaaagaaugucuuaaaauucuaagcagucuuucuucuucuucucuuuauuaacagcaauuaacucucuc

SEQ ID NO: 6786 - RNA, 96 nt, Homo Sapiens
gggagcaaguuuaggggucagguagugcuccucuuuuccccugaaaucacacaagaaugaggagggcuuucccugacuuugcaaagacucccuccc

SEQ ID NO: 6787 - RNA, 114 nt, Homo Sapiens
gggagcucuuuugcaaaacaaaagaugucuucuuuucccuuagcccuugguuuuguuuggcagaugguguaggugaagagaacauuaguuguggaagagguauguaugacuccc

SEQ ID NO: 6788 - RNA, 92 nt, Homo Sapiens
gggaggacugcuugagcccaggagguggagucuguagugagcugugauccugccacugcacuccagccugggcaacagagcaagacccugcc

SEQ ID NO: 6789 - RNA, 105 nt, Homo Sapiens
gggaggagagaaggaaccauagauucugagaaacacaccaggaugacuaggccuggaggaguccagggugggccucagacccucacuucuugucuggcaccuccc

SEQ ID NO: 6790 - RNA, 77 nt, Homo Sapiens
gggaggaggugaaggaacaaaugcugaacaccuguuauuuaugaagcacucuacauauguucuuucauuucacuccu

SEQ ID NO: 6791 - RNA, 90 nt, Homo Sapiens
gggaggaucgcuugagccuaggaggucaaggcugcagugagcugagaucacaccacugcacuccugccuaggugacaaagugagacuguc

SEQ ID NO: 6792 - RNA, 92 nt, Homo Sapiens
gggaggauugcuugagccuggaagcuggagccugcagugaacuaucauugugccacuguacuccagccuaggcaacaaaaugaaauccuguc

SEQ ID NO: 6793 - RNA, 82 nt, Homo Sapiens
gggaggccaaggugggaagauugcuugagcccuggagguugagacaagccugggcaacauagcaauaccccauuuguuucuu

SEQ ID NO: 6794 - RNA, 113 nt, Homo Sapiens
gggaggcugagggggaggaucacuugagcccaggaguucaaggcugcagugagccaugauugcgccacugcacuccagccugggcaacagagcaagacccugccccgccgccu

SEQ ID NO: 6795 - RNA, 92 nt, Homo Sapiens
gggaguccacggaagcgugagaauggaggaagaacagugcuuugagugacugcugcagggucuuccuauuauuuuuaguucugaggauucuc

SEQ ID NO: 6796 - RNA, 109 nt, Homo Sapiens
gggauagcucauuuuugaaaucaguuuagaacauuuaaaaugugggaaauucaaauaaaaaugcaaauuuucacuguuuucuaaaaagucagaucaacauugcuggccc

SEQ ID NO: 6797 - RNA, 90 nt, Homo Sapiens
gggaugccaaacccucucccuguguuacauuagugcuaugacugaacauaaacacugcuguaauggacggugagaucuucgugucauccu

SEQ ID NO: 6798 - RNA, 91 nt, Homo Sapiens
gggauggaaaaugcagacacaauauagcaaauagagggucuuuuccugucauggaaaucggucagcccugaugcuucugcauuucuuuccc

SEQ ID NO: 6799 - RNA, 101 nt, Homo Sapiens
gggauuacaggcaccugcugccaagucuggcuaauuuuuguauuuuuaauagagacgggguuucgcuauguuggccaggcuggucucgaacuccugaucuc

SEQ ID NO: 6800 - RNA, 93 nt, Homo Sapiens
gggcaguggcagagaaugaauguauguguggguuucucagccuugagguauaaggucuaaaggcucuggggauucacugcauacaccacuucc

SEQ ID NO: 6801 - RNA, 88 nt, Homo Sapiens
gggcauuuugccucugguagggauggccauggugccagcccuccugggccucauuggguaucaccuauacagaaaggccaauagaccc

SEQ ID NO: 6802 - RNA, 105 nt, Homo Sapiens
gggccaaaaauucaagaugcucauuugcaaguugucuucuaggguguugccugaaccuaggcugcaguagaaguggggcuuggagguaggcgauauugaaauccc

SEQ ID NO: 6803 - RNA, 96 nt, Homo Sapiens
gggcgaguccuuaaccuuggcaaaauaaacuucugaauuuauugagaccugucucagguacuuuuugguuuacaugugcuugugagggcaggcacc

SEQ ID NO: 6804 - RNA, 86 nt, Homo Sapiens
gggcgggggcccucgucuuacccagcaguguuugggugcgguugggagucucuaauacugccggguaaugauggaggccccugucc

SEQ ID NO: 6805 - RNA, 85 nt, Homo Sapiens
gggcugacuuggacucugaaauguuaagcaacuugcucuccaggaguccugugaagaaguugcuucauccuuuugaagucugccc

SEQ ID NO: 6806 - RNA, 93 nt, Homo Sapiens
gggcugggcaagauggcucauguuuguagucucaguacuuugggaggccaaagaugggaggauugcuugagcccgugaguuugagaccagccu

SEQ ID NO: 6807 - RNA, 81 nt, Homo Sapiens
gggcuugcuggguuuacagauggcaaagaucuggcaaauuaaaaauagccuuaggccaaagaucaaacccaaggugggcuu

SEQ ID NO: 6808 - RNA, 82 nt, Homo Sapiens
gggcuuuugcccuagauggacaaguucaaauccuggcucagucacuuaggaaauuuggcuguuugucuugggcaaguugcuc

SEQ ID NO: 6809 - RNA, 106 nt, Homo Sapiens
ggggacauaaccguagguggccgugccaacaggaaaccccaggaagucuggcuucagagccauucccuuuagcucugauggcacacugucuuguaguucagucuuc

SEQ ID NO: 6810 - RNA, 126 nt, Homo Sapiens
ggggaugugacuccugauaugaaauccauugccaaggcugaccuuaucgucacuacgccagagaagugggauggagucagcagaagcuggcaaaauaggaacuauguucagcaagucacuauucuc

SEQ ID NO: 6811 - RNA, 88 nt, Homo Sapiens
ggggcagagcggauggaagccggagaucccagguucccggaauacuccggcuggggccuucgggcuucuccuguccccucccuacccc

SEQ ID NO: 6812 - RNA, 91 nt, Homo Sapiens
ggggccucaaguuacgacuucucaaggcagugacaucuuccucaauugguaugaguagcugccaggcaacaaguacguauaagaguguccc

SEQ ID NO: 6813 - RNA, 89 nt, Homo Sapiens
ggggcuucgccacugauuguccaaacgcaauucuuguacgagucugcggccaaccgagaauuguggcuggacaucuguggcugagcucc

SEQ ID NO: 6814 - RNA, 88 nt, Homo Sapiens
ggggcuucuucccuggcaggauuccugggauuucaaacuaccucaccaacaggacgcugaaccaggagccugccacccaacuggcccc

SEQ ID NO: 6815 - RNA, 87 nt, Homo Sapiens
gggggacagagcgagacuccaucuuuucugggagacuccauugggagacugucuuuuuugggagacggagucgugccuuaguuuccc

SEQ ID NO: 6816 - RNA, 96 nt, Homo Sapiens
gggggaggaucacuugagcccaggaguucaaggcugcagugagccaugauugcgccacugcacuccagccugggcaacagagcaagacccugcccc

SEQ ID NO: 6817 - RNA, 78 nt, Homo Sapiens
gggggccacauucucugggcauucagaagccaggauuucauaggccaugaaaucugcugucuuuuagaagugggcucc

SEQ ID NO: 6818 - RNA, 82 nt, Homo Sapiens
gggguauaggcacugagaagcaaacaggauucaucugagaacaucgguugcaugucucugugcuucaguguucaagucuccc

SEQ ID NO: 6819 - RNA, 82 nt, Homo Sapiens
gggguuguccuuaaguucccucugccugcaguccugcuuuguuuuggacaaguaggagugacaagcaggucagcacagcccu

SEQ ID NO: 6820 - RNA, 114 nt, Homo Sapiens
ggguaccagaugugcuuccuguccucaguaaagaacuuggaguauguuguuccucaaauaucuuuugaugaaugggugcuccaggaguuucuacugacaggcuacauuuuaucc

SEQ ID NO: 6821 - RNA, 86 nt, Homo Sapiens
gggucacuguaugguaccagugucagcuuccuguguuacacgagauggcacaguugggugaagcuggugaugaagguaugugaccc

SEQ ID NO: 6822 - RNA, 115 nt, Homo Sapiens
gggugcauggacuaggacccuggaggcagaaauaguuaccgaggggaaguuacaggccugagugugagucccuguuugguugcugaugagcuuugagguccuuggccagacacuc

SEQ ID NO: 6823 - RNA, 95 nt, Homo Sapiens
gggugccuggaagcuacugcuucuucuagucaaauggaaaucuuucaaugaugccagguggugcuguuaagaagcagaauucuuccccuaagccc

SEQ ID NO: 6824 - RNA, 90 nt, Homo Sapiens
gggugugaaggaaacauccucccccuuguuuucaaccuaguaggccaguuuagaaacaagccacagggaagguguugucagucauuacuc

SEQ ID NO: 6825 - RNA, 112 nt, Homo Sapiens
gggugugguggagcacgccuguuaucccagcuacucaggaggcugaggugggagaaucaccugagcccgggagguagagguugcagugaguggagaucgugucaccacacuc

SEQ ID NO: 6826 - RNA, 65 nt, Homo Sapiens
ggguucuuuuuccgcuuucugagcccuuuuauaccuuacguuuagaaggggaaaaucauccuccc

SEQ ID NO: 6827 - RNA, 80 nt, Homo Sapiens
ggguuguccuuaaguucccucugccugcaguccugcuuuguuuuggacaaguaggagugacaagcaggucagcacagccc

SEQ ID NO: 6828 - RNA, 74 nt, Homo Sapiens
ggguuguuacaugcaugaugcugagguuugggaauauggauggucccaucacccaggugauguauguaguaccc

SEQ ID NO: 6829 - RNA, 103 nt, Homo Sapiens
gguaagauugguggccaccacauucagucuccuucacagcuaaguguagccacauaacuaugcuuuggccacggggauaugaaugcuacuacuaauuuuuucc

SEQ ID NO: 6830 - RNA, 99 nt, Homo Sapiens
gguacaugucacuacuguucauagucucuuugcuggaacuugguccuauggcccuacuggcagagaggaaggcuaugaaacccagucuaggccugcgcc

SEQ ID NO: 6831 - RNA, 97 nt, Homo Sapiens
gguagguuuagaaugaggucugugucacugugguauuacgauauuuugacugguuauuauaaccacagugucacagaguccaucaaaaacccaugcc

SEQ ID NO: 6832 - RNA, 114 nt, Homo Sapiens
gguaguggugauucaaagcaagaugguagcauuggagaggaugagauauggucagaugaggauauauuuuaaaaguugagcuaacaggauuugcugaggaaucagaagugaacc

SEQ ID NO: 6833 - RNA, 69 nt, Homo Sapiens
gguauacuuacuagcauauuauauagcucuaagaguguagaguuauaugaugugcuagugaaguguauu

SEQ ID NO: 6834 - RNA, 86 nt, Homo Sapiens
gguauugggagaaaaguguguuaucuagguaguccaggaaggucuuccuuucaugacaauacccauagacacuuagucccuugacu

SEQ ID NO: 6835 - RNA, 95 nt, Homo Sapiens
ggucagugcuuuaagugaaucuacucagagcugugaaaucuugggggaauuugacccagucacaguugagagaagguucuggaaggauaugggcu

SEQ ID NO: 6836 - RNA, 80 nt, Homo Sapiens
gguccagauguggccaugggagacugaggggcggacguguuccugggugcuuccuucaucucagucuccucacugagacc

SEQ ID NO: 6837 - RNA, 76 nt, Homo Sapiens
ggucgagguggguguaucgcuugagcccaggaguuugaguccagccugggcaacauagugagaccuugucuugacc

SEQ ID NO: 6838 - RNA, 101 nt, Homo Sapiens
ggucguuugcuuuucagugaccagguucuucauacacauggaugucucacagaucagcuaaggccuguguuugaacaccuuggucaccccugcaaggagcc

SEQ ID NO: 6839 - RNA, 106 nt, Homo Sapiens
ggucucccucuugcccaggcuggagugcagugaugcaaucauaguucacugcaaccuucuggguucaagugauuuuccugccucagccucccaaguaguugagacu

SEQ ID NO: 6840 - RNA, 130 nt, Homo Sapiens
ggucugugugaagcaucacuuugcagggauuacuaaugguggggcagcaggucugugaauuaaguuaucucuugaccucacccucaugucaacacaaauguaauuccuaaacaagaugcauugccagucu

SEQ ID NO: 6841 - RNA, 110 nt, Homo Sapiens
ggugaaacugcccuuuccuuucuguucuaugagugugaugguguuugagaaaauguggggcuaugguucaggcgcacuucacaugugcaaagauggagaaagcacucacc

SEQ ID NO: 6842 - RNA, 96 nt, Homo Sapiens
ggugacaagagucucacucugugguccagacuggaguauagugcuaucagagcuuacuacaacuuuaaacuucugggcucaggugauccucccacc

SEQ ID NO: 6843 - RNA, 79 nt, Homo Sapiens
ggugaggaaguguuauugucagggucucccuuucagaaggccuuggggccaaggggaggagcuggaauugccuuccacc

SEQ ID NO: 6844 - RNA, 98 nt, Homo Sapiens
ggugcaaacaccccguucauguaacacgggccugaggucagcaguagaggaccaguauugguuuuggccccagccucugcguggauggauugaacgcc

SEQ ID NO: 6845 - RNA, 71 nt, Homo Sapiens
gguggagcagaaaggcaggaguccugcucccuggcaccaucauggagcaugcccagcccagaucugccccc

SEQ ID NO: 6846 - RNA, 72 nt, Homo Sapiens
gguggagcagaaaggcaggaguccugcucccuggcaccaucauggagcaugcccagcccagaucugcccccc

SEQ ID NO: 6847 - RNA, 86 nt, Homo Sapiens
gguggcacuggcaggaugugccuccugaggugugucgaguguucucuacauggggcacuguggaggugucaucggcucaguucccc

SEQ ID NO: 6848 - RNA, 95 nt, Homo Sapiens
ggugggaggacugcuugagcccaggagguggagucuguagugagcugugauccugccacugcacuccagccugggcaacagagcaagacccugcc

SEQ ID NO: 6849 - RNA, 94 nt, Homo Sapiens
ggugguaaagcccuggagugaggcaggaaccccaaagcccuaugacaccccauauagguacccccaaaccugccuauacuucaggccaggcccc

SEQ ID NO: 6850 - RNA, 95 nt, Homo Sapiens
ggugguaaagcccuggagugaggcaggaaccccaaagcccuaugacaccccauauagguacccccaaaccugccuauacuucaggccaggccccc

SEQ ID NO: 6851 - RNA, 85 nt, Homo Sapiens
gguggugagaggggccuggggcgugguguggagggucgaguucuuugucgucccacagucacccccaggaccaccuugcgaagcc

SEQ ID NO: 6852 - RNA, 68 nt, Homo Sapiens
gguggugggugugaggaagggcugggcacuuucacugucuuuuccuucauaaacuggcaagcacuacc

SEQ ID NO: 6853 - RNA, 76 nt, Homo Sapiens
ggugguuauggugaugugcaccuguagucucaucugcuuuggaguugaggcugcagugaacuaugaucgugccacu

SEQ ID NO: 6854 - RNA, 120 nt, Homo Sapiens
ggugucugccugguugaucuugaaugauggcaagugggcacuuuucagguaacuauugaugauuaacugacaaagaucugugaaggcuacacuuugucacuucagagugccagagauacc

SEQ ID NO: 6855 - RNA, 92 nt, Homo Sapiens
gguucacacauuggugccuuugcugggacaaaaaagagacuuuccugaggguugucuuguuccaguuucucagccacucaccaugugauacc

SEQ ID NO: 6856 - RNA, 87 nt, Homo Sapiens
gguugccgugauugaggaggugcuaccagcgucugcugggcagagaccagggaugcugcuccacaucccacaaugcacaggacaauc

SEQ ID NO: 6857 - RNA, 73 nt, Homo Sapiens
gguuggaaugaggaaggguguggucuucggcuaaaauuugcauaaaacggaacccauccgggcgauuccaacu

SEQ ID NO: 6858 - RNA, 82 nt, Homo Sapiens
gguuuccuggaacuuugggggaucauuauaaaaauacuaggguaaaaaagcaaccuuaguaaucccagcaauuugggaggcc

SEQ ID NO: 6859 - RNA, 125 nt, Homo Sapiens
guaaaucucccugauaccaucacucuuaaaccuuuagaaaugcuacagcaucuagcuucucuagaucaauaaucacagaggcuuaagugcugaccucauaaagauaaagaguucccaugauuuac

SEQ ID NO: 6860 - RNA, 84 nt, Homo Sapiens
guagagaaccucaucaugagauuugagaauagcuuuagaguuacucuugggauagugucucauggcccugugagggaacucuac

SEQ ID NO: 6861 - RNA, 74 nt, Homo Sapiens
guagagauggaguuuuacuauguugcccagguugaucuugaacuccugggcucaagugauccucccaucuugac

SEQ ID NO: 6862 - RNA, 77 nt, Homo Sapiens
guagaggguaugccugggaaaacaggagucacagaagcuucugugacuguauuuucccaaagagguuuauuauuuau

SEQ ID NO: 6863 - RNA, 74 nt, Homo Sapiens
guagaggugggguuucuccauguuggucaggcuggucuuuaacuccugaccucaggugauacgcccgccuuggc

SEQ ID NO: 6864 - RNA, 89 nt, Homo Sapiens
guaggaggagucagggauuuucugguuugagagacaaugacacacaccccuaaguucaccuucucucgaauaguaggcccugcucuuac

SEQ ID NO: 6865 - RNA, 111 nt, Homo Sapiens
guaguccaccucauaaaaucagaaaguauuacuggucucccacuuuuaggcuauuaacgcuuguagugagaguuuguagguuucuugucgugguugccaggggcugggggc

SEQ ID NO: 6866 - RNA, 74 nt, Homo Sapiens
guagucccagcuauucaggagcuugaggugggaggaucacuucggcccaggagucugaggcuggagugagcuau

SEQ ID NO: 6867 - RNA, 108 nt, Homo Sapiens
guaguuaccauugccuuuucugugagcuauuuguuuugguuugcugaaacuaguccaaaacaggaaauuuaacagacagccacagccaaagagugucaugugaauuac

SEQ ID NO: 6868 - RNA, 90 nt, Homo Sapiens
guauaacgcaaaacacaauuucuaaauagucaaaaguuuuuccuggcaaggagacuuuuguagacaccuacccugugaucaucugugugc

SEQ ID NO: 6869 - RNA, 85 nt, Homo Sapiens
guauggggcaacuuggggcgugaugucagccagaguccuuccaccaaggcuuuuaugguguuacgugauccaccaccccauuaac

SEQ ID NO: 6870 - RNA, 90 nt, Homo Sapiens
gucagcaccgagguagcagagaauuaacauucuugucagcagagaaugaagcaggaauauaauuaaaacuuugcccuuggaauagcugau

SEQ ID NO: 6871 - RNA, 110 nt, Homo Sapiens
gucaggacuguuggcuaagggaaugucugcuuggacugaucauugaacaaucuuuccaacuaaaagcuucuaugauucucuaaguagcaaucagcaccgacaguuaugau

SEQ ID NO: 6872 - RNA, 87 nt, Homo Sapiens
gucaguccugauggcagcugugcagagugggggugaggaggccaacuuacugcuuccugaacugggcagugccuucuaugacauggc

SEQ ID NO: 6873 - RNA, 75 nt, Homo Sapiens
guccacacugaccuucugugucauggcauaugcccaugucaggcagugcugugcuaaaggaaggauuacauggac

SEQ ID NO: 6874 - RNA, 99 nt, Homo Sapiens
guccacugauauucacuagccuguuuguccucaccccugaagcagauaaacacauguagauggaggaaaagugacaggcagguggguucaucagugggc

SEQ ID NO: 6875 - RNA, 110 nt, Homo Sapiens
guccacuggcccuucuugucuuagguccucacacacagcucugcucaguucaaucacccagaaugcaggcugguuggugaggcaaauuuggacagaagaagucagugucc

SEQ ID NO: 6876 - RNA, 110 nt, Homo Sapiens
guccauccuuugaacaugacuccugguguguuagucuagucuguucucaugcugcuaauaaagacauaccugagacuggcuaauuuauaaaggaaagagguuuaauggac

SEQ ID NO: 6877 - RNA, 103 nt, Homo Sapiens
guccaucuucaguggcauugggccuuggcugggaugcugaguuauccacuggagcaucggcaguacaggcaggcacagaggcaguggauccaucggagguggc

SEQ ID NO: 6878 - RNA, 74 nt, Homo Sapiens
gucccaaagaaaaggaaaacccagcaagggcaugguccaucugcugccuuuucugggcucccuuuucugcugac

SEQ ID NO: 6879 - RNA, 91 nt, Homo Sapiens
guccccuuucucuuucuaccauacccccaguaaagcuacuuaaaauccucuguaggaaagagcugaguaauugggggcagagauggaggac

SEQ ID NO: 6880 - RNA, 87 nt, Homo Sapiens
gucccuaucacucggagcggagaccugagcuaugagucaucagugaggugcuauacucagagccauuccgcucaggucauggaggac

SEQ ID NO: 6881 - RNA, 74 nt, Homo Sapiens
guccuggaagacaugguagagcugaaggaucagccaacuuugagacucagcucuagcugccugucuccaguggc

SEQ ID NO: 6882 - RNA, 100 nt, Homo Sapiens
guccuguacugcucaauucagugaccacuagccauauguggcuacugagcacuugaaauguggcuaguuugaacugagaugugcucuaaguacacuggau

SEQ ID NO: 6883 - RNA, 112 nt, Homo Sapiens
guccuuuagucucuauuuuugcuccuaauuguuccugcagguaguagguuaacauguaacguacuuacagaaggaagcaauugaacauggcauagauacugaaagaaagggc

SEQ ID NO: 6884 - RNA, 93 nt, Homo Sapiens
gucuaaccagucccagugagaugaaccagguaucucagcuggaaaugcagaaaucaccugccuucucuguuggucucccugggagcugcagac

SEQ ID NO: 6885 - RNA, 130 nt, Homo Sapiens
gucuaggucugauaauuuucauucauuucuuucauggacauggugacucuuuucuugccauccuuaaggagaaaagccauggacacuacaaaaucuuugagguuugaagugggaacuaggagauucaggc

SEQ ID NO: 6886 - RNA, 88 nt, Homo Sapiens
gucuauuaugagucugacuggcacagacaucugucaaggaagaaggauucuuugagcguauuugugucagucaacugcauauauggac

SEQ ID NO: 6887 - RNA, 102 nt, Homo Sapiens
gucucucagagguagagugugucuauggaagggguugucaugguaacagcuucuguuggcuucuagcccuaccuuuucuggacacauucaugcuagagggau

SEQ ID NO: 6888 - RNA, 76 nt, Homo Sapiens
gucucuguugcccaggcuggagugcaguggcgcaaucucagcucacugcaaccuccaccuccuggguucaagcgau

SEQ ID NO: 6889 - RNA, 81 nt, Homo Sapiens
gucugaaauccaggugugggcagggccgugcucccuccgaaggcucuaggggaggauccuugcucaacuuauuuuugagac

SEQ ID NO: 6890 - RNA, 93 nt, Homo Sapiens
gucuggcauucccuagugagaugaacccgguaccucagauggaaaugcagaaaucacccaucuucugugucgcucaugcugggagcuguagac

SEQ ID NO: 6891 - RNA, 88 nt, Homo Sapiens
gucugucucuaguguuuuuccaaaugacauccagggcucuggccguggagucccugaugugaucgcuaaaggaccuccggagaggggc

SEQ ID NO: 6892 - RNA, 76 nt, Homo Sapiens
gucuucauaucuccagguucugcuggagcaauuaccucccccaucuggcuccuuaggaccuagagguaguaaaggc

SEQ ID NO: 6893 - RNA, 65 nt, Homo Sapiens
gugaacccgggagacggagcuugcagugagcugagaucgugccacugcacuccagccugggcaac

SEQ ID NO: 6894 - RNA, 83 nt, Homo Sapiens
gugacguagguuuguacgucaacucagccuuauucugggaaaucauuaauccuuaacucugaugacugugcaaaaguagucac

SEQ ID NO: 6895 - RNA, 113 nt, Homo Sapiens
gugacuccugauaugaaauccauugccaaggcugaccuuaucgucacuacgccagagaagugggauggagucagcagaagcuggcaaaauaggaacuauguucagcaagucac

SEQ ID NO: 6896 - RNA, 98 nt, Homo Sapiens
gugacuuuccaggugucacacagugaguggcauaaucagaguacaauuugagucaugcccauacaucacauugccagugauuacccaaggaaagugac

SEQ ID NO: 6897 - RNA, 79 nt, Homo Sapiens
gugagauguguuccaggaagucgucuugagcacccauugcucagaguuuauauuggacuugcuuucuagcacauaccac

SEQ ID NO: 6898 - RNA, 84 nt, Homo Sapiens
gugaggcucuggcaaggugugggcuagagaugcgacucaguuggaucuaucucucagaaggcuaccuuguaaguagaguuccac

SEQ ID NO: 6899 - RNA, 78 nt, Homo Sapiens
gugauccacacgcuggcccaggaguucgacauuuaccgcgaggugggcggagagccugugccugugacgagggaugau

SEQ ID NO: 6900 - RNA, 121 nt, Homo Sapiens
gugauucagccagacgugauggaggaaauggugguaucuuguguuauuaagcacuugaacuugguugaugcacugcagucucuaauaaauuuccaauaucaagaagaacaugcugaagaau

SEQ ID NO: 6901 - RNA, 102 nt, Homo Sapiens
gugcacuacagacuccagccucccuuugaagccagguuccagagcuuccucccuuuggccuggaaccucaacagcaggauugggaugaggauggaaguguac

SEQ ID NO: 6902 - RNA, 102 nt, Homo Sapiens; identical to SEQ ID NO: 6901

SEQ ID NO: 6903 - RNA, 83 nt, Homo Sapiens
gugcaguacaaagacaguucagugacaaguuccauccauaccauggaagaggguuaaacuuguggcuguuuuugccacagcau

SEQ ID NO: 6904 - RNA, 83 nt, Homo Sapiens
gugcauuucuauuucuaguuuuucacggaacugaccaggcaauucagucaguagcugucaaaacuggaguccagaacaggcac

SEQ ID NO: 6905 - RNA, 103 nt, Homo Sapiens
gugccuagccaagcagaugaaugagguagaacagucuuguucauacauugccauuauaucuagugcaguugaaugaacauuuucugugucugggcuuaggugc

SEQ ID NO: 6906 - RNA, 131 nt, Homo Sapiens
gugccucaucuguaggugguugagagaaugaaaggagguagcaugagcagggcacucagcucggaggcagugccuagccaacauugcuuaucuucacugugaauuuggcuuuuuuccuacucuugaaucuu

SEQ ID NO: 6907 - RNA, 87 nt, Homo Sapiens
gugcuagggggucaccuaugugggagccagcucugccuccugccccgaagcuccagagacuucuccuacaacugacucucuggacac

SEQ ID NO: 6908 - RNA, 104 nt, Homo Sapiens
gugcugggucaaacagccuuuauuuuagcaguugugagacccuagagaacuccuuugguguuuuggggucuccccagcaugcacaauggggguuaugcuagcau

SEQ ID NO: 6909 - RNA, 88 nt, Homo Sapiens
guggacuuaggagguagagagugcuuuggguguaggccagguaaguuucuggucugccugcauuaggcacuugguagcuguuagcuau

SEQ ID NO: 6910 - RNA, 97 nt, Homo Sapiens
guggacuuugauguguguguaggaaaauauuaaggugggauguguggaucaguguccuagcacauucccgcaggguguaagccuggcacuaucauac

SEQ ID NO: 6911 - RNA, 97 nt, Homo Sapiens; identical to SEQ ID NO: 6910

SEQ ID NO: 6912 - RNA, 101 nt, Homo Sapiens
guggcauagggugggccuuuaauccaaugugacugguguccauauaagagguggagaaauguagagacacagacacaugggagaaggccaugugauggcac

SEQ ID NO: 6913 - RNA, 66 nt, Homo Sapiens
guggcguuuauucccuuaguauguaggugacccaggguggcuuugcuuuggcaagggagaagucac

SEQ ID NO: 6914 - RNA, 77 nt, Homo Sapiens
guggcucgacucuugaccauggcugggguuccugaggaugagcuaaacccuuuccauguacuggggguugaggccac

SEQ ID NO: 6915 - RNA, 88 nt, Homo Sapiens
gugggaggaggacuggcaaaaauaugagaguaggaguuugggcucuugagcuugggccuggccuucaaauuuccacucuuucacucac

SEQ ID NO: 6916 - RNA, 112 nt, Homo Sapiens
guggguauucagagagagaagauaaugaauagggagugucagaaugccagcaucauuugccucaaaugccacuuguuacgugcuuccacucuuuuauucucucugaggacau

SEQ ID NO: 6917 - RNA, 74 nt, Homo Sapiens
guggguggugcagggguggucuuaggagggcuuuccugaaggaguggccaggguucacccaucuuuccacccac

SEQ ID NO: 6918 - RNA, 98 nt, Homo Sapiens
guggucauaagguccuuucuggcucuaauaaccugagcuucuguuaugaagcugggacccuuagagccucaggaugauccucuguuuguuugugaagc

SEQ ID NO: 6919 - RNA, 93 nt, Homo Sapiens
guggugcauaccuguaaucucagauacuugggagguugaggugguaggauugcuugagcucaggaguuugaggcugcaguaagcuaugaucac

SEQ ID NO: 6920 - RNA, 93 nt, Homo Sapiens
gugguguaugggaucugcauggagguggucuaugagaaagcaaaccccagugagugcugcuucgggauucucuccaacugcaaccaugccuac

SEQ ID NO: 6921 - RNA, 85 nt, Homo Sapiens
guguagcaugcaucaguacuucaccuacuguauggauauacuaugcuuuaaaaauccauucauuaggccaggugcgguggcucac

SEQ ID NO: 6922 - RNA, 87 nt, Homo Sapiens
guguagcaugcaucaguacuucaccuacuguauggauauacuaugcuuuaaaaauccauucauuaggccaggugcgguggcucacgc

SEQ ID NO: 6923 - RNA, 97 nt, Homo Sapiens
gugucccuuccaagcuguguuaacuguucaaacucaggccugugugacuccauuggggugagaggugaaagcauaacauggguacagaggggacaac

SEQ ID NO: 6924 - RNA, 93 nt, Homo Sapiens
gugucugguuuccaggaggcaggcgugcugucugaagaggcuuuggaaguaccccaaauaauucaguucuugaccugccccagggccacacac

SEQ ID NO: 6925 - RNA, 109 nt, Homo Sapiens
gugugaccuuggcccugugaggcuucaccucuugagccugagaagcagaggugacaguacuggcccugguucuuagcagggggguggcgggcaggguaggggguggcgc

SEQ ID NO: 6926 - RNA, 79 nt, Homo Sapiens
gugugacuuuagugcuacucugauuuuacuguucaggaaagugaagcagagagguucaaugucuuacucaaggucacac

SEQ ID NO: 6927 - RNA, 113 nt, Homo Sapiens
gugugauauagguggucugggaucauggcuggacaaacacaaugcaguaggaagagugcuggcucuuggucacugcugugugacccaaugaucuugagcaucacccgucauac

SEQ ID NO: 6928 - RNA, 108 nt, Homo Sapiens
gugugguggagcacgccuguuaucccagcuacucaggaggcugaggugggagaaucaccugagcccgggagguagagguugcagugaguggagaucgugucaccacac

SEQ ID NO: 6929 - RNA, 97 nt, Homo Sapiens
gugugucugguuuccaggaggcaggcgugcugucugaagaggcuuuggaaguaccccaaauaauucaguucuugaccugccccagggccacacacau

SEQ ID NO: 6930 - RNA, 98 nt, Homo Sapiens
guguuagagaccaguuaaaguuaagacacuuucuaaauagaagucuuguauauggggcuuuugagaaaguguuuucccgugaugcuggggggaaacac

SEQ ID NO: 6931 - RNA, 80 nt, Homo Sapiens
guguucgagcacacaccuccuugcaguggcuucagcacccaggucuccgggagccagugaaggaaccaaguguuggauac

SEQ ID NO: 6932 - RNA, 75 nt, Homo Sapiens
guguugagauccuuucacaguugugguuacaauuacguucacaagcuacaccugccaugagagaauacuuggcac

SEQ ID NO: 6933 - RNA, 76 nt, Homo Sapiens
guguuuggaauagagcccagucugaaauuauaagcacugggguacuccuaugugucugggacucuaugccaaguau

SEQ ID NO: 6934 - RNA, 75 nt, Homo Sapiens
guguuuugcacuguaauaccucggucguagcaaagugccgugggaccgaaguauuauggugcagugacuugacgc

SEQ ID NO: 6935 - RNA, 94 nt, Homo Sapiens
guuaccuuccucugccucugcucccuugucuagggcguggagaugagguguccuuccuauucacaggguugcugcgaggacagagugaguuggc

SEQ ID NO: 6936 - RNA, 112 nt, Homo Sapiens
guuacuucagcaaguagaagauggauauuuuugaugcccagaguguugucuuccccguccaggguaucucauucugaucaaaccgaauuggccauccauacugagaaguggc

SEQ ID NO: 6937 - RNA, 90 nt, Homo Sapiens
guuaugaagcuuguaggggguuuagcuccacagggucagaccugcaggugcaaacaggcccuaggcgaacccccuggaggaaacguugac

SEQ ID NO: 6938 - RNA, 114 nt, Homo Sapiens
guuccucuucucauuggcugaugugcucuguggcaucugucacagguuuuaauugaaggucagcaguggcagguaagccaccagcaucaucagcuucuuucagccuuuuggaac

SEQ ID NO: 6939 - RNA, 95 nt, Homo Sapiens
guuccuuaggccacacccugcccucccuggacugccugaccucgcuccaaggcucaggggaagguucugagggcaggugugaaaaugcuuggaau

SEQ ID NO: 6940 - RNA, 89 nt, Homo Sapiens
guucucuauggcuaggcaguaaagaaacagcacccuucauauuuuaagggacugugcuacauuucuucauucuuggcgauuuugagaau

SEQ ID NO: 6941 - RNA, 131 nt, Homo Sapiens
guuuaaaugguuauccgggagaauuccuguuguguggaagaugcuuugcccuuucuucaucuggaaaucauuuuuccauccuuuaggucacagcuuaaacaugauuuucccaggaauuuuucucugaccac

SEQ ID NO: 6942 - RNA, 81 nt, Homo Sapiens
guuuaagaauggcucauguaguacccagcuacucugggcgacugagcccaggguacucugggaucacuugagcccaggagc

SEQ ID NO: 6943 - RNA, 100 nt, Homo Sapiens
guuucccacuuuucucccaucugucauuuuucucuuuccauaaaaagcuaauggugacguuaucaaagagugaaggagucagaggcuaaggguggggaac

SEQ ID NO: 6944 - RNA, 111 nt, Homo Sapiens
guuuggaggucuguugcuuccuugaggcacgguaaggagugguuccaauuuggggugcucacgggauccacagaucucuccuuucuuuccucugccuccccaucuccugau

SEQ ID NO: 6945 - RNA, 90 nt, Homo Sapiens
guuuggugccuauuggauuuuaagcauugggaguugaccuuuauauaaaacaaaaccccuaagcuuauaauucaguagggagaaacagac

SEQ ID NO: 6946 - RNA, 97 nt, Homo Sapiens
guuuggugccuauuggauuuuaagcauugggaguugaccuuuauauaaaacaaaaccccuaagcuuauaauucaguagggagaaacagacaguaaac

SEQ ID NO: 6947 - RNA, 96 nt, Homo Sapiens
guuugugggaggaggacuggcaaaaauaugagaguaggaguuugggcucuugagcuugggccuggccuucaaauuuccacucuuucacucacuagc

SEQ ID NO: 6948 - RNA, 86 nt, Homo Sapiens
guuuugaaggaugcgguguggagccagaggaugugugggagggguuucucuaacacugacuucuauuccaugagcuuuuucaaggc

SEQ ID NO: 6949 - RNA, 100 nt, Homo Sapiens
guuuugacaaaugcagauacauguguaacugaacuuaugacuuuccuuauagaaacuucagaaaguucccucauaccccuuaucucaaucuugucacuac

SEQ ID NO: 6950 - RNA, 96 nt, Homo Sapiens
guuuuuacuauaacauauuuuagaaagcuaacaagcuagagagagcggugaagggcucucucagcauguuccucucugucuguguguuaguuuugc

SEQ ID NO: 6951 - RNA, 128 nt, Homo Sapiens
uaaaacucaccaucaaauagauguaaucuuauuaauuacacauuuuguauuuuaauuauuucaaggagugaagaaaacaggguguuuuuguuuuuguaguucugauuacucauuuaugcauuguuuug

SEQ ID NO: 6952 - RNA, 122 nt, Homo Sapiens
uaaaucugggcugagggaaagcauguccacaccaggugcccagacaucugguuggcuuuggcugauuuguccugcaggcaccugccuugucuggauuugcacacuuuccaaguugcccauua

SEQ ID NO: 6953 - RNA, 122 nt, Homo Sapiens; identical to SEQ ID NO: 6952

SEQ ID NO: 6954 - RNA, 78 nt, Homo Sapiens
uaaauuggaaugacagaagaugagagcuaggaagugguauauuuaauuucuagauuucagggcuggagugguggagua

SEQ ID NO: 6955 - RNA, 79 nt, Homo Sapiens
uaacauauuuuagaaagcuaacaagcuagagagagcggugaagggcucucucagcauguuccucucugucuguguguua

SEQ ID NO: 6956 - RNA, 80 nt, Homo Sapiens
uaagaggcaggcauucuggguaucagacauaaauccccucccaggaacuuuuguguccugacccagaggacuggcucuug

SEQ ID NO: 6957 - RNA, 73 nt, Homo Sapiens
uaagaugaguugauauucaaauauccaguuaguaaugaaaacaauacaauacugagagaaaaagcuugucuug

SEQ ID NO: 6958 - RNA, 130 nt, Homo Sapiens
uaaggaauguggaaaaaccuuuauuuguggcucagaccuuacucgacaucacagaauucacacuggugagaaacccuaugaauguaaggaaugugggaaagccuuuaguagugguucaaacuucacucga

SEQ ID NO: 6959 - RNA, 130 nt, Homo Sapiens
uaaucuuaacauucucaacuaugauuaccaaagcagaaaaauaaaacacauuaaaucacaugcuggcuuaugaaagccuccaucuuuaagugacaugugcacucucguucauaguucauuggccaaagaa

SEQ ID NO: 6960 - RNA, 106 nt, Homo Sapiens
uacauguguuacacucaguguguaaauaacugugaagaggcaauugucagauagcaaauugggcaccugcuguguacgguauauugcacuggggcugacgggugug

SEQ ID NO: 6961 - RNA, 87 nt, Homo Sapiens
uaccuucuuugcugccugggagaugcugcuaugggcguuuauuugaucugcuuguggcucaguuugcucagcagugaaaugaaggug

SEQ ID NO: 6962 - RNA, 130 nt, Homo Sapiens
uacuugggaucaguuagucuagagccugcaaagcaaguggcuuggagagauagugauuuagcucaagagggagugagaugugacuguugccacauguuaaaugcuuuucugggccugauuauuuaaggga

SEQ ID NO: 6963 - RNA, 109 nt, Homo Sapiens
uacuugugcagguuuguuaaauggguuuauuguguaaugcugagauuugggcuucuaaugaucccauugcccaaguagcaaacauaguaccuaauagaaucaauaggua

SEQ ID NO: 6964 - RNA, 76 nt, Homo Sapiens
uagaaauauguaaucgaucuuuucuuuggugggcaauuagcaauauugaggaaaguuaaagauguauguaucccua

SEQ ID NO: 6965 - RNA, 76 nt, Homo Sapiens
uagaaaugagagaugagagguccucuggguaaguggggaacuguuuggucucaucgccuccauuucuacaucucua

SEQ ID NO: 6966 - RNA, 105 nt, Homo Sapiens
uagaagcaucuuuaguuuuaaggaagugucucuuggcuggccccuagauagcuuuaggaugggagcuagucaccagaaacaccaauccuugauuagaagcuugua

SEQ ID NO: 6967 - RNA, 111 nt, Homo Sapiens
uagacuugggagggaaccuuacaguccucuacuccagcucccugauuuuacagaucggggacccaccauucagggcugauaacaaacucaggucucuucacccucagucug

SEQ ID NO: 6968 - RNA, 89 nt, Homo Sapiens
uagcaccccuugcccugugucuguggaacagaagcagcuuccuucagagaagacugcagcucccaaggacacaagcuguugggaugcua

SEQ ID NO: 6969 - RNA, 99 nt, Homo Sapiens
uagcugcacaacacaagcccacaggcaaacacacagacuccugcagugucuagagcagucacugggauaugaagacuguguguggaggcugggcagcua

SEQ ID NO: 6970 - RNA, 72 nt, Homo Sapiens
uaggaaugggaugguuguuuuagguaggcuugggagccaggcugcccugaacucuggccauccacacuucua

SEQ ID NO: 6971 - RNA, 102 nt, Homo Sapiens
uaggagggaggauugcuugaguccaggaguugaaggcuacagugagcuuugaucacaucacugcacucuagccugagcaacaaagcaagaccucaucucuua

SEQ ID NO: 6972 - RNA, 89 nt, Homo Sapiens
uaggcuguaugcuguuaaugcuaaucgugauagggguuuuugccuccaacugacuccuacauauuagcauuaacaguguaugaugccug

SEQ ID NO: 6973 - RNA, 110 nt, Homo Sapiens
uaggggcaguggcagagaaugaauguauguguggguuucucagccuugagguauaaggucuaaaggcucuggggauucacugcauacaccacuuccaguucaagcgccua

SEQ ID NO: 6974 - RNA, 109 nt, Homo Sapiens
uaguauguugagcaucuuuuuguaaguguacuugccaucuguagaucuucuuuggugaagugucuguucagaucugugugcauuuuuaauuggguuguuuaacuuauug

SEQ ID NO: 6975 - RNA, 96 nt, Homo Sapiens
uagucucauccagguaugacaugugccacugugucugaaauuccugagcaccgagggccgcuucaggcaccaggcacuuugccaaccugagagcug

SEQ ID NO: 6976 - RNA, 99 nt, Homo Sapiens
uagugacaagggcaucccaaggcacuugcccagagcugcagaguugugugugccauaccugcggcucaaagggaaggccuucuauccccugaguuucua

SEQ ID NO: 6977 - RNA, 123 nt, Homo Sapiens
uagugagaugaacccgguaccucagauggaaauggagaaaucgccugucuucugcgucucucacgcugggagcuguagaccggagcuguuccuauuuggccaucuuggcuccucucuccucug

SEQ ID NO: 6978 - RNA, 103 nt, Homo Sapiens
uaguguucaagaccuacacuccauccuccuuuaauuugcccaguggccugacacuuggcagggcaagugcugucauauggaagaucuguuuacgugaacauua

SEQ ID NO: 6979 - RNA, 130 nt, Homo Sapiens
uaguguucacauguugcucaguuuugcuaacugauaaaucauuuaauccucuucuucauauguaugaguacuaucuuauaucuguggucaagagugagguaagcaagcuccaacagacccugagaaccua

SEQ ID NO: 6980 - RNA, 77 nt, Homo Sapiens
uaucucaucugguuuuaauccugaaggcauauauguaugacauuaucugucuuuagggaggagacccaacagaggua

SEQ ID NO: 6981 - RNA, 76 nt, Homo Sapiens
uaugaacuggccacuuuucagaugaaaccuggugggccagcucuguggggugaugcauuuaaaagggcaguucaug

SEQ ID NO: 6982 - RNA, 99 nt, Homo Sapiens
uaugagggacaugaacaccugcagauuuugggguccacagggguccuggaauuaauucccuguggauacugagagaugacuggacauccauucuccaug

SEQ ID NO: 6983 - RNA, 104 nt, Homo Sapiens
uaugggaaaaaaggcaguuuagaaaaaaguacauuugguauacaugcauagagaugugcauagcaaauggucugaaugaauggccuuagaccacaguuuucaua

SEQ ID NO: 6984 - RNA, 94 nt, Homo Sapiens
uaugucaccaaauuuggugugcuuucuccuuugccugcugcuucuuucaaguaggacauggagacaacagccaaauuugugcuucagugaugug

SEQ ID NO: 6985 - RNA, 114 nt, Homo Sapiens
uauuauugggcaccuguuaugugagacacuguccuaggcacugugggauaacaacagcaaacacuucacacaacagccuggccuuccuguguuuuacaacagcuccuaaagaua

SEQ ID NO: 6986 - RNA, 106 nt, Homo Sapiens
uauuccagauuucuuaguuuugcucagcaggaugguuggacugaagggggcugguuuacuucuucaguggaaguguucauuuuugcaaauacuaguuacuggaaua

SEQ ID NO: 6987 - RNA, 105 nt, Homo Sapiens
uauugguuucauucuugguaaagaaaucauaaaaguccaggacagaaagugaccuauagggaugaccuggccucuugcccuuuucuuugcuucuggaaagcagua

SEQ ID NO: 6988 - RNA, 109 nt, Homo Sapiens
ucaaguccuguacugcucaauucagugaccacuagccauauguggcuacugagcacuugaaauguggcuaguuugaacugagaugugcucuaaguacacuggauuuuga

SEQ ID NO: 6989 - RNA, 101 nt, Homo Sapiens
ucaauacuuuaaaggcacacuugucugcuuucuacacuguugccggagaagggucauaaagugaaguuuggcagaaaaguuuggccauugucuaguacuga

SEQ ID NO: 6990 - RNA, 107 nt, Homo Sapiens
ucacauucuccauaacuggauaugagggaagcaugggaccaugaucccuggagggacugcagggauugcccacgcuagucaucucacuguacagcuggagaaacuga

SEQ ID NO: 6991 - RNA, 124 nt, Homo Sapiens
ucacccagugguucucucagcaacagacauguccaguggaccguaguguugugacggucgcccaucugcgcccaguaccucggaucaugcggaacauguugucaaagcugcagauugccuguga

SEQ ID NO: 6992 - RNA, 80 nt, Homo Sapiens
ucacccuguugccuaggcaggacggaaugcagugaagucaucauaguuuacuguaacacugaacuccugggcucaaguga

SEQ ID NO: 6993 - RNA, 130 nt, Homo Sapiens
ucacgucucugcaaaguagcaagugguuauguucauaucauuuugaaagcugaguggauagauuuaaauagcaagagcuuuguucggaaugauguguggaacccagaaucacagacccugcgauacauga

SEQ ID NO: 6994 - RNA, 76 nt, Homo Sapiens
ucacucugucgcccaggcuggagugcagugguacagccucagcucacugcaaccuccaccucccgggcucaaguga

SEQ ID NO: 6995 - RNA, 73 nt, Homo Sapiens
ucacucugugguccagacuggaguauagugcuaucagagcuuacuacaacuuuaaacuucugggcucagguga

SEQ ID NO: 6996 - RNA, 76 nt, Homo Sapiens
ucacucuguugcccaggcuggagugcaguggugcaaucuuggcucacugcaaccuccaccucccggguucaaguga

SEQ ID NO: 6997 - RNA, 76 nt, Homo Sapiens
ucacuggaacccaggagguggagguugcagugagucaagauagugccacugcacuccagccugggcaacagaguga

SEQ ID NO: 6998 - RNA, 78 nt, Homo Sapiens
ucacuggaaccugggagguggagguugcagugagcugagacugugccacugcacuccagccugggcaacagagcaaga

SEQ ID NO: 6999 - RNA, 76 nt, Homo Sapiens
ucacuuaaacccgggagguggagguugcagugaguggagauggugccacugcacuccagccugggugacagaguga

SEQ ID NO: 7000 - RNA, 77 nt, Homo Sapiens
ucacuugaacccaggagacggaguuuguggugagccgagaucacaccauugcacuccagccugggcaacaacaguga

SEQ ID NO: 7001 - RNA, 78 nt, Homo Sapiens
ucacuugaacccgggaaggcggagguugcagugagccgagaucgugccacugcacuccagccugggcaacaagaguga

SEQ ID NO: 7002 - RNA, 77 nt, Homo Sapiens
ucacuugaacccgggaggcggagguugcagugagcugaggucgugccacugcacuccagccugggcaacaagaguga

SEQ ID NO: 7003 - RNA, 76 nt, Homo Sapiens
ucacuugaacccuggaggcagagguugcagugagccgauaucaugccacugcacuccagccugggcaacacaguga

SEQ ID NO: 7004 - RNA, 77 nt, Homo Sapiens
ucacuugaacucgggaggggaggcugcagugagccaagaucacacaccacugcacuccagccugggcaacaaaguga

SEQ ID NO: 7005 - RNA, 76 nt, Homo Sapiens
ucacuugagcccaggaguuggaggcugcagugagcuaugauugcaccacuguacuccagccugggugacagaguga

SEQ ID NO: 7006 - RNA, 76 nt, Homo Sapiens
ucacuuuggugauaucaugggaagguguacuuccggugaugccuagaggucacguccugugaugucauuaggcuga

SEQ ID NO: 7007 - RNA, 87 nt, Homo Sapiens
ucagagacaccucucauuucuccucaaugccacugcacugaugucaacugacuuagggcaggcaugagagaacugagguuuacaugg

SEQ ID NO: 7008 - RNA, 114 nt, Homo Sapiens
ucagaucaguagugacaugagauuuucauaggagcagaaacccuauugugaacuccaaacacaagggaucuagguuaugcacuacuuaugagaaucuaaugccugaugaucuga

SEQ ID NO: 7009 - RNA, 111 nt, Homo Sapiens
ucagccagacgugauggaggaaauggugguaucuuguguuauuaagcacuugaacuugguugaugcacugcagucucuaauaaauuuccaauaucaagaagaacaugcuga

SEQ ID NO: 7010 - RNA, 102 nt, Homo Sapiens
ucaggccuggagcccaggaagucugguuucgaauuucaugcuucuaaccugagcacuguacugcuugguggaguucucugcuaguccuaccuuucaggcaga

SEQ ID NO: 7011 - RNA, 107 nt, Homo Sapiens
ucagucccuuugggugugacugcuguacacauuuucauguuaccauugacaucuucaguuuuucaaugugauguguaaugcauauaagcagcauauguagugguuga

SEQ ID NO: 7012 - RNA, 81 nt, Homo Sapiens
ucaguucuguuuaucugaaggcuccuacccagagauucuacccagugaaacucccacagcagcgcagguagauggggcuga

SEQ ID NO: 7013 - RNA, 84 nt, Homo Sapiens
ucauacuguaauguuaguuugcaugaaaagcucuguggugcaguggcaaacagggcuaaggauguuugcugaugucgcagugga

SEQ ID NO: 7014 - RNA, 91 nt, Homo Sapiens
ucauagucugcguuuguuugugcccaucuuuuuugggaagucuuuccagguauucacagagacuugggccucaaacugaaugaugcugugg

SEQ ID NO: 7015 - RNA, 123 nt, Homo Sapiens
ucaucuauccccuaggccagauuaucuuaucagcuacugacccaguuagcuuuccuacuucacaacagguuucuaaugcuuuaugucagugugagagaaauggcaaguugggaaaauuuguga

SEQ ID NO: 7016 - RNA, 131 nt, Homo Sapiens
ucaugguuccuggaagguaagauugguggccaccacauucagucuccuucacagcuaaguguagccacauaacuaugcuuuggccacggggauaugaaugcuacuacuaauuuuuucccuugaaacaaugg

SEQ ID NO: 7017 - RNA, 84 nt, Homo Sapiens
ucauuccucuuaaucuucacuaaaauggacaaguauucauugagcaccuaaugcguguucaguauggugggagaugagggauga

SEQ ID NO: 7018 - RNA, 101 nt, Homo Sapiens
uccacaguuugaucucuucucuguucccuccacacucuucuuuugcuccucuuccuguauuucagagugguuaagaucauggaagucagacaagcuauggg

SEQ ID NO: 7019 - RNA, 100 nt, Homo Sapiens
uccacuacuguuguggcuuuugcaaauuacuaaauuucucugugacuacuuuuccauuucuuaaguaauuugguugguuuccaaaagucaauaaugugga

SEQ ID NO: 7020 - RNA, 88 nt, Homo Sapiens
uccagacacuuucuuccuucaguucagggaacccucaauacacaguaagaaugaagagguugcaggucugagcuugaggaggacugga

SEQ ID NO: 7021 - RNA, 93 nt, Homo Sapiens
uccaggucuggggcaugaaccuggcauacaauguagauuucuguguucguuaggcaacagcuacauugucugcuggguuucaggcuaccugga

SEQ ID NO: 7022 - RNA, 86 nt, Homo Sapiens
uccaguucuucugggagaaaaauggcaggcuucuggggaaagaaagccagcugaauuuugacuccaucuccccagaagaugcuggg

SEQ ID NO: 7023 - RNA, 76 nt, Homo Sapiens
uccauugccaaggcugaccuuaucgucacuacgccagagaagugggauggagucagcagaagcuggcaaaauagga

SEQ ID NO: 7024 - RNA, 75 nt, Homo Sapiens
ucccacagucgggaggaaaagaaagaagacucuguuguucauuguuuuuaucuuuuucuccagaugccuguggga

SEQ ID NO: 7025 - RNA, 96 nt, Homo Sapiens
ucccagauucuuccugguggaggcauucggagagcaacacccuggccuuaacacacuacauaucuuugaauuucacacgggggcagccuucuggga

SEQ ID NO: 7026 - RNA, 106 nt, Homo Sapiens
uccccuaggccagauuaucuuaucagcuacugacccaguuagcuuuccuacuucacaacagguuucuaaugcuuuaugucagugugagagaaauggcaaguuggga

SEQ ID NO: 7027 - RNA, 98 nt, Homo Sapiens
uccccuuccucuuucccucccaguuguaaauaacauuuuuuagcagcaauguaaucugcuaaauguuaguuguuuagggaaguccugagaaaagggga

SEQ ID NO: 7028 - RNA, 110 nt, Homo Sapiens
ucccggaguuuauggucuggugagaagaucccugcucugagucacugccaagcucuagcuaugugacuuugaacagggaauuucugucccuaucuauaaaauaaacgggg

SEQ ID NO: 7029 - RNA, 83 nt, Homo Sapiens
ucccuaucacgugcagcuuugcugacgucauugagagauaaauuagguacaagugggcagagaauuguaugugagguuaggga

SEQ ID NO: 7030 - RNA, 93 nt, Homo Sapiens
ucccuccugugucccaaaacgaaaacacuccuauauuuuguagcgccuuccagaauggggcagcggaaacuaguguugggacaaaggaggcga

SEQ ID NO: 7031 - RNA, 111 nt, Homo Sapiens
ucccucugcuagugaguacaaaugaagucugugggccaacaaggagcgaggagcaguuuccuggaagcccugggcugguguuugacuugcuuugagauagaauaaauggga

SEQ ID NO: 7032 - RNA, 94 nt, Homo Sapiens
ucccugaccacaccuuuacucagaagucuaaggaacagacuguuuaaccuguuuccagugguuucagggacuucuguauuggguguagcaagga

SEQ ID NO: 7033 - RNA, 91 nt, Homo Sapiens
ucccuguccugucuucgaguauuuguuuuuaaugcugggugucgaucgagacaacaagcgcucagagcaaagcaaggaugcauuacggggg

SEQ ID NO: 7034 - RNA, 73 nt, Homo Sapiens
ucccuucagagcccauggguuucccauucccuccugucagcccuggccaugaaauccuggggaucuggaggga

SEQ ID NO: 7035 - RNA, 94 nt, Homo Sapiens
ucccuuuuauuaaccaucuucccuuucucgaguauacacaaguagaaaagaaacagugaaguaccccgauagggaggguggggagaggauggga

SEQ ID NO: 7036 - RNA, 99 nt, Homo Sapiens
uccuacaacuugagucuuugauacuggugucacuuucaggagcucuaagaauacgucaacucucgcuucugaguuggugaccccucaaccaagaaagga

SEQ ID NO: 7037 - RNA, 62 nt, Homo Sapiens
uccucagcguguuaacugaagccuuguugaguuuaacaaagcugccauugaagaucugggga

SEQ ID NO: 7038 - RNA, 100 nt, Homo Sapiens
uccuccagugaacggugacuugacagagguacauaggaggcuacuuguucucuuguuggcugcuuguauuugcuuucuggaagguuauuguuuucaagga

SEQ ID NO: 7039 - RNA, 108 nt, Homo Sapiens
uccucccccaggcauucuggucacuguuccuuuuuguugagaucauucucggugucucauauagcuggguugcagcuccguucuuugccaggaggugguaauagagga

SEQ ID NO: 7040 - RNA, 108 nt, Homo Sapiens
uccucuccacgcuuuacuuuuagguaacugcuuuuguugugcagggacugguguaccacagcacaccuccucccgccuggaguaaagcagcugaccgcgugaagggga

SEQ ID NO: 7041 - RNA, 92 nt, Homo Sapiens
uccugacgggguccucuggcugcauuuaggaacaaggagcuccccgaguaaccugaaguccacucugcccagaggccccacaacuuacagga

SEQ ID NO: 7042 - RNA, 79 nt, Homo Sapiens
uccugaggccuggagauacuagaggguaaaggaauggaaccaugucuggggucccuuuaguaacuugcagggucuggga

SEQ ID NO: 7043 - RNA, 76 nt, Homo Sapiens
uccugcauggcaguuccauaugcagagccagaauccauccuuguuccuucugcauugugagaaaauccauggagga

SEQ ID NO: 7044 - RNA, 74 nt, Homo Sapiens
uccugugcugcaguagaaauuagagcauguccugcuuuaugcaggcuuugcuuuaguucuucugaaguguauga

SEQ ID NO: 7045 - RNA, 76 nt, Homo Sapiens
uccuucaguggaugauguuuucuguggucuuguucaggaauuuacaaacuagaggaagccuuaucucaccaaggga

SEQ ID NO: 7046 - RNA, 90 nt, Homo Sapiens
ucgcagucagacguuuggcaacagcaguggaagaggcaacuggugcuuuucagcuaggccuugaaaaauugcuucagagguugauuucga

SEQ ID NO: 7047 - RNA, 78 nt, Homo Sapiens
ucgcucuuuguugcccaggcuagagugcaguggcaugaucucggcucacugcaaccucugccuccuggguucaagcga

SEQ ID NO: 7048 - RNA, 78 nt, Homo Sapiens; identical to SEQ ID NO: 7047

SEQ ID NO: 7049 - RNA, 77 nt, Homo Sapiens
ucgcuugaacccaggaaguggagguugcagugagccaauauugugccauugcacuccagcuugggcaacaagagcga

SEQ ID NO: 7050 - RNA, 76 nt, Homo Sapiens
ucgcuugaacccaggagguggagguugcagugaaugaagaucgugccacugcacuccagccugggcgauagagcga

SEQ ID NO: 7051 - RNA, 77 nt, Homo Sapiens
ucgcuugaaccccggaggcagagauugcagugagccgagaucaugccacugcacuccagccugggcaacaagagcga

SEQ ID NO: 7052 - RNA, 76 nt, Homo Sapiens
ucgcuugaacccgggaggcagagguaguagugagcugaagucccgccacugcacuccagccugggcaacagagcga

SEQ ID NO: 7053 - RNA, 77 nt, Homo Sapiens
ucgcuugaacccuggagguggagguugcagugagcugagaucguagccacugcacuccagucugggugacagaguga

SEQ ID NO: 7054 - RNA, 77 nt, Homo Sapiens
ucgcuugaacucgggaggggaggcugcagugagccaagaucacacaccacugcacuccagccugggcaacaaaguga

SEQ ID NO: 7055 - RNA, 77 nt, Homo Sapiens; identical to SEQ ID NO: 7054

SEQ ID NO: 7056 - RNA, 77 nt, Homo Sapiens; identical to SEQ ID NO: 7054

SEQ ID NO: 7057 - RNA, 77 nt, Homo Sapiens; identical to SEQ ID NO: 7054

SEQ ID NO: 7058 - RNA, 77 nt, Homo Sapiens; identical to SEQ ID NO: 7054

SEQ ID NO: 7059 - RNA, 74 nt, Homo Sapiens
ucgcuugaacucgggcggcggaaguugcagugagcugagauugcaccacugcacuccagccugggcaacaguga

SEQ ID NO: 7060 - RNA, 76 nt, Homo Sapiens
ucgcuugagcccaggaguucgaggcugcagugagcugugaucacaccacugcacuccagccugggcaacagagcga

SEQ ID NO: 7061 - RNA, 107 nt, Homo Sapiens
ucuagggagacccaggacccgggagagagguagaggggagcagagacagccaccagcuucuaucuucugcucuaagcacauucuuucacgaguuuaaguuuccuaga

SEQ ID NO: 7062 - RNA, 113 nt, Homo Sapiens
ucuauaugagacuaacuaagguauuugccccuuggagcuuuuauagucuuuaaaaugagauaaugucugugaaaugcuuuuaggacacugccuggcauaaacacucaugaaga

SEQ ID NO: 7063 - RNA, 97 nt, Homo Sapiens
ucucaacuucuuuaugucucuguacaguggguguagggaccagccacacagggucgguggguuuuucuccccgugugcagagaugagagauuguaga

SEQ ID NO: 7064 - RNA, 71 nt, Homo Sapiens
ucucccaggcaauauuccaggauaggcugccaguuggacuaaggaagccacuccugcggaacccugggaga

SEQ ID NO: 7065 - RNA, 127 nt, Homo Sapiens
ucucucuucccucucaucauagauuaaucacuuaguugcaagggaccaguaaauuaacagaauggugaacauuuuccuuuucuuggugcuuuugcuggaugacuagugguuucugcuggaacagaga

SEQ ID NO: 7066 - RNA, 99 nt, Homo Sapiens
ucucucuuucccaggcuuccuguccuucagcaaggccaccugagaacugaauuguaaauuccagccuugcaaggaaggggaggaggcugaaagacaaga

SEQ ID NO: 7067 - RNA, 100 nt, Homo Sapiens
ucucugagccucugcugcuuuucuuguguaacaaaaugaauaauaccugcccugaggggcuauggcagguaaaggagagugcaggcagagguugcagagg

SEQ ID NO: 7068 - RNA, 85 nt, Homo Sapiens
ucucuggcacuuccaaucuccuaccugugauagacgucuaagugaaaguacuagcuuaguuguuugggauugguagugacagaga

SEQ ID NO: 7069 - RNA, 74 nt, Homo Sapiens
ucucugucuuccauuccccuccuacgcccccagacugugagggguguaaggaagauggaagauguugcgggagg

SEQ ID NO: 7070 - RNA, 101 nt, Homo Sapiens
ucucuuaacaauuuccgggcugaacagccucaccagcaugccauguacuaccuccgcuugcugaugacugaaguggccuggacuaaagaugaguuaaaaga

SEQ ID NO: 7071 - RNA, 79 nt, Homo Sapiens
ucugagucagugggcugagaaaggcugcccaccuuucaucuaggugggcacaacguaaucagcugccagcuugaccaga

SEQ ID NO: 7072 - RNA, 77 nt, Homo Sapiens
ucugauccuggaacugcauugcuugguggucaggagggguucuuaguaagcaaacucaguuuaaucccagagucgga

SEQ ID NO: 7073 - RNA, 96 nt, Homo Sapiens
ucugccaguuuuuaugccacacuggcucugugcuucuaguaucugcauuuaaugcuuagauucuaccagagcuaguuugggcacaaaguuuccaga

SEQ ID NO: 7074 - RNA, 110 nt, Homo Sapiens
ucugcucaugauuacugggccaauaccacugcaaugacugucagaacaauucuugugaaaguuguuuuuauaagccuuguaguuuguugaaguugagguucaagggcaga

SEQ ID NO: 7075 - RNA, 102 nt, Homo Sapiens
ucugucucucucucaucuuccuuuugccacccaggcuggaauguaguggugugaucacagcucacuacagccuggauucagcacacaggaaucagagucaga

SEQ ID NO: 7076 - RNA, 87 nt, Homo Sapiens
ucugugguugaaggaauggauggaagugugugagcuagauugcacagauagcaagcagaacauuucuggugaacuuggacacacaga

SEQ ID NO: 7077 - RNA, 89 nt, Homo Sapiens
ucuuaccccaguauccuauuaucucauaccuaaggcagugaugguuucucagaccucuuagauugagaagauguggcauggguguaagg

SEQ ID NO: 7078 - RNA, 98 nt, Homo Sapiens
ucuucauuauccucuauaucauugcuaugcccugguguugugcccgggguacaacacguaguagguguucgauaaacuuggguuggauaaauggaaga

SEQ ID NO: 7079 - RNA, 93 nt, Homo Sapiens
ucuuucacuggaaucacaucugcagcuccucccccuccgcccucccucaggcuuagaccguggagcuguaacagaucuguucuucgugugaga

SEQ ID NO: 7080 - RNA, 90 nt, Homo Sapiens
ucuuucccaggcuuccuguccuucagcaaggccaccugagaacugaauuguaaauuccagccuugcaaggaaggggaggaggcugaaaga

SEQ ID NO: 7081 - RNA, 114 nt, Homo Sapiens
ucuuucucuaauuuguccaccaguaguaugcaucuuuuucuccacuagccaggggcuauggaggcccugaauagaacagaagagcagcuagcaagggcggaaggaagagagaga

SEQ ID NO: 7082 - RNA, 130 nt, Homo Sapiens
ucuuuucuuugguaggcuagccuucgagacugcauuacccuccccaacuuaaaaucuuuugauaacccaggcagcuggguuauccccaauuuaaagucuuuuuguuguagcuguauggcauuuaucuaga

SEQ ID NO: 7083 - RNA, 79 nt, Homo Sapiens
ucuuuuucucagugucucuguuguggcagucaugaaugagacucugucagaucuccauggcagggaccugauugacaga

SEQ ID NO: 7084 - RNA, 110 nt, Homo Sapiens
ugaaccagcuucucagcucuacuguguuugacccuguguucaagguuaggggaauuauaguuucccaggucuccaucguggggguaaucagaggggcagagaaggcuuca

SEQ ID NO: 7085 - RNA, 101 nt, Homo Sapiens
ugaaccccggagacagagguugcagugagccgagauacauacauauauauguauauaucaugugcaacuuggcucugcuccuuuguaaguuugugggcuua

SEQ ID NO: 7086 - RNA, 92 nt, Homo Sapiens
ugaagacuccaucacaguuccagauggguaggaauaccuugcagggcuggggcaagguauugccuucucuggaaggcugugcauucucuuca

SEQ ID NO: 7087 - RNA, 109 nt, Homo Sapiens
ugaaucacuguggaaaacaucaguaauucaacaaccuugcugcugaccucuuauucaguuaaaugagagcaaguguugaaacagcugguggugguucacaucaaaauca

SEQ ID NO: 7088 - RNA, 82 nt, Homo Sapiens
ugaauuugugacuugucugguuuggcaucucgaagggcuuucucuacuggguccagggugccacagaacaggucagcauuca

SEQ ID NO: 7089 - RNA, 101 nt, Homo Sapiens
ugacaaucuugguuaccauccauuaagugcugcugauuuuggaaagaucaugaaaaacgucuuuccaaacaugaaggcacgucguuugggcacaagaggca

SEQ ID NO: 7090 - RNA, 113 nt, Homo Sapiens
ugacacuuucuguaaacgccaucugugcuuuucucccauuuguacugcccuguauauccccguucagcauugccaguguuuccagccaccucuuaaagcauucugaaguuuca

SEQ ID NO: 7091 - RNA, 99 nt, Homo Sapiens
ugacccuccagaccucacauuuguucuggagcccauacucaccaaucagcuuuagcuuuuggucgagaugagguuucucgaagggucucugcaggguca

SEQ ID NO: 7092 - RNA, 100 nt, Homo Sapiens
ugagaaggagucucauucuguugccuaggccggagugcagugacaugaucuuggcucacugcaaucuccaccuccagguucaagugauucuccugccuca

SEQ ID NO: 7093 - RNA, 95 nt, Homo Sapiens
ugagaagucaguccugauggcagcugugcagagugggggugaggaggccaacuuacugcuuccugaacugggcagugccuucuaugacauggcca

SEQ ID NO: 7094 - RNA, 92 nt, Homo Sapiens
ugagaauugcuugaacccaggaggcagagguugcagugagccgagaucgugccacugcacuccauccugagugacaaagcaagacugucuca

SEQ ID NO: 7095 - RNA, 101 nt, Homo Sapiens
ugagacaaaagaauugcuugaaccugggagguggaaguugcagugagccaagauugugccacugcacuccagccugggcaauaaggcaagacuccgucuca

SEQ ID NO: 7096 - RNA, 99 nt, Homo Sapiens
ugagacagaagaaucgcuugaacucgggcggcggaaguugcagugagcugagauugcaccacugcacuccagccugggcaacagugagacucugucuca

SEQ ID NO: 7097 - RNA, 101 nt, Homo Sapiens
ugagacaggagaaucacuugaacuccggagguugagguuucagugggccgagaccgagcgacugcacuccagccugggcaacagagcgagacuccauuuca

SEQ ID NO: 7098 - RNA, 102 nt, Homo Sapiens
ugagacaggagaaucgcuugaacccgggaggcagagguugcagugagaugagaucacaccacugcacuccagccugggcaacaagagcgaaacuccaucuca

SEQ ID NO: 7099 - RNA, 101 nt, Homo Sapiens
ugagacaggagaaucgcuugaacccgggagguggagguuacggugagugagaucgcgccauugcacuccagccugggcaacaagagcgaaacuccgucuca

SEQ ID NO: 7100 - RNA, 101 nt, Homo Sapiens
ugagacaggagaauugcuugaaccuggcaggcggagguuacagugagccaagaugguaccacugcacuccagccugggcaacauagcaacacucugucuca

SEQ ID NO: 7101 - RNA, 98 nt, Homo Sapiens
ugagacaguaucacuugaacccaggggguggagguugcggugagccgagauugugccacugcacuccagccugggcaacagagugagacucuguuuca

SEQ ID NO: 7102 - RNA, 102 nt, Homo Sapiens
ugagacggaguuucgcucuugucccccaggcuuuagugcaauggcgcgaucucggcucaccgcagccuccgccaccuggguucaaacgauucuccugccuca

SEQ ID NO: 7103 - RNA, 91 nt, Homo Sapiens
ugagaggacugcuugaacucgggguggagguugcagugagccaagaucgccccacugcacuccagccugggcaacaaugcaagaccccuca

SEQ ID NO: 7104 - RNA, 104 nt, Homo Sapiens
ugagauggaguuuugcucuuguugcccaggcuguaguguaauguagugcaaucuuggcuuaguacaaccucugccuccuggguucaagccauucuccugccuca

SEQ ID NO: 7105 - RNA, 101 nt, Homo Sapiens
ugagaugggaggacugcuugagcccaggagguugagguugcagugaaccaugaucaugucacugcacuccagccuggguaacagagugagaccuuguuuca

SEQ ID NO: 7106 - RNA, 93 nt, Homo Sapiens
ugagauuucuaaggcacugcuucuaaguaggaaucacacugcaguggguuagugacacccugcucagaaauggugccugugcaaaauguuuca

SEQ ID NO: 7107 - RNA, 100 nt, Homo Sapiens
ugaggcaagagaaucacuugaacucaggagguggagguugcagugagccaagaugcaccacugcacuccagccugggcaacagagugagacucugucuca

SEQ ID NO: 7108 - RNA, 102 nt, Homo Sapiens
ugaggcaagagaaucgcuugaacccaggaggcagagguugaagugagccgagaucgugccauugcacuccagccugggcaacaagagcgaaacuccgucuca

SEQ ID NO: 7109 - RNA, 103 nt, Homo Sapiens
ugaggcaaggucagaaaaggucaggcaauuuuugccuuguucauugcaacacucccuuuggagcucugaguuuaagcuaagaagucugacuaccuugcugcca

SEQ ID NO: 7110 - RNA, 106 nt, Homo Sapiens
ugaggcacaagaauugcuugaaccugggagggggagguuucagugagccgagccgagauugugucacugcacuccagccugggcaacagagugagacucugucuca

SEQ ID NO: 7111 - RNA, 101 nt, Homo Sapiens
ugaggcacgagaaucgcuugaacccaggaggcggaggcugcagugagcagagaucacgccacugcacuccagccugggcaacagagggagacucugucuca

SEQ ID NO: 7112 - RNA, 101 nt, Homo Sapiens
ugaggcagaagaaucucuuaaacccgggaggcggagguugcagugagccgagauugcgucacugcacuccagccugggcaacagagcgagacuccguuuca

SEQ ID NO: 7113 - RNA, 101 nt, Homo Sapiens
ugaggcaggaaaaucacuugaacccuggaggcagagguugcagugagccgauaucaugccacugcacuccagccugggcaacacagugagacucugucuua

SEQ ID NO: 7114 - RNA, 99 nt, Homo Sapiens
ugaggcaggaaaaucgcuugaacccaaggcagagguugcagucagcagauauugcaccacugcacuccagccugggcaacaaagcaagacucugccuca

SEQ ID NO: 7115 - RNA, 99 nt, Homo Sapiens; identical to SEQ ID NO: 7114

SEQ ID NO: 7116 - RNA, 99 nt, Homo Sapiens; identical to SEQ ID NO: 7114

SEQ ID NO: 7117 - RNA, 102 nt, Homo Sapiens
ugaggcaggaaaauggcuugaacccgggagguggagguugcagugagcugagauugcgccacugcacuccagccugggcaacaagagcaaaacuccgucuca

SEQ ID NO: 7118 - RNA, 101 nt, Homo Sapiens
ugaggcaggaagaucacuugagcccaggagguggaggcugcagugacccauauucaugccacugcacuccagccugggcaacagagugagacccucucuca

SEQ ID NO: 7119 - RNA, 101 nt, Homo Sapiens; identical to SEQ ID NO: 7118

SEQ ID NO: 7120 - RNA, 101 nt, Homo Sapiens; identical to SEQ ID NO: 7118

SEQ ID NO: 7121 - RNA, 101 nt, Homo Sapiens; identical to SEQ ID NO: 7118

SEQ ID NO: 7122 - RNA, 101 nt, Homo Sapiens; identical to SEQ ID NO: 7118

SEQ ID NO: 7123 - RNA, 101 nt, Homo Sapiens
ugaggcaggacaaucacuugaacccaggaguuugaggcugcagugagccgagaucacgccacugcacuccacccugggcaacagagcaagaucuugucucg

SEQ ID NO: 7124 - RNA, 104 nt, Homo Sapiens
ugaggcaggagaaccgcuugaacccaggaggaggaggagguugcagugggccgagaucgagccacugcacuccagccugggcaacagagugagacuccaucuca

SEQ ID NO: 7125 - RNA, 100 nt, Homo Sapiens
ugaggcaggagaaggcgugaacccaggaggcggagcuugcagugagcagagaucgugccacugcacuccagccugggcaacagagcgagacuccgucuca

SEQ ID NO: 7126 - RNA, 102 nt, Homo Sapiens
ugaggcaggagaauagcuugaacccaggagguggagguugcagugagucgagauugcaccauugcacuccagccugggcaacaagagcaaaacucugucuca

SEQ ID NO: 7127 - RNA, 101 nt, Homo Sapiens
ugaggcaggagaauagggugaacccaggagguggagcuugcagugagccgagaucgcgccacugcacuccagccugggcaacagagcgagacuccgucuca

SEQ ID NO: 7128 - RNA, 102 nt, Homo Sapiens
ugaggcaggagaaucacuugaacccaagaggcggagguugcagugagcugagaucgcgccacugcacuccagccugggcaacaagagcaaaacuccgucuca

SEQ ID NO: 7129 - RNA, 101 nt, Homo Sapiens
ugaggcaggagaaucacuugaacccaggaagaggagguugcaguaagccgagaucgugccacugcacuccagccugggcaacaaagugagauucccucuca

SEQ ID NO: 7130 - RNA, 101 nt, Homo Sapiens
ugaggcaggagaaucacuugaacccaggaggcagagguugcagugagcugagaucaugccacugcacuccagccugggcaacagagugaggcuccuucuca

SEQ ID NO: 7131 - RNA, 102 nt, Homo Sapiens
ugaggcaggagaaucacuugaacccgggaggcagagguugcagugagccaagaucgcaccacugcacuccagccugggcaacaagggcgagacucugucuca

SEQ ID NO: 7132 - RNA, 102 nt, Homo Sapiens
ugaggcaggagaaucacuugaacccgggagguggagcuugcggugagccgagaucgcgccauugcacuccagccugggcaacaagagugaaacuccaucuca

SEQ ID NO: 7133 - RNA, 101 nt, Homo Sapiens
ugaggcaggagaaucacuugaacccgggagguggagguugcagugagcugagauugcgccacugcacuccagccugggcaacagagcgagacuccaucuca

SEQ ID NO: 7134 - RNA, 100 nt, Homo Sapiens
ugaggcaggagaaucacuugaaccugggaggcaagagguugcagugagcugagaucauaccacugcacucuggccuggguaacagagcgagacugucuca

SEQ ID NO: 7135 - RNA, 102 nt, Homo Sapiens
ugaggcaggagaaucauuugaacccaggagguggaaguugcagugagcucagaucgcaccauugcacuccagccuggguaacaagaaugaaacuccaucuca

SEQ ID NO: 7136 - RNA, 101 nt, Homo Sapiens
ugaggcaggagaaucgcuugaacccagaaggcagagguugcagugagccaagauggugccacugcacuccagccugggcaacagagcgagacucuaucuca

SEQ ID NO: 7137 - RNA, 102 nt, Homo Sapiens
ugaggcaggagaaucgcuugaacccaggaggcggagguuguggugagcgaagaucgugccauugcacuccagccugggcaacaagagcaaaacucugucuca

SEQ ID NO: 7138 - RNA, 102 nt, Homo Sapiens
ugaggcaggagaaucgcuugaacccaggagguggaggcuguggugagcugagauugcgccauugcacuccagccugggcaacaagagcgaaacuccaucuca

SEQ ID NO: 7139 - RNA, 102 nt, Homo Sapiens
ugaggcaggagaaucgcuugaacccaggagguggagguugcagugagccgagaucgcgccauugcacuccagccugggcaacaagagcagaacuccgucuca

SEQ ID NO: 7140 - RNA, 101 nt, Homo Sapiens
ugaggcaggagaaucgcuugaacccagguggcaaggcuugcagugagcugagaucgcacuacugcacuccagccugggcaacagagcgagacuccagcuca

SEQ ID NO: 7141 - RNA, 103 nt, Homo Sapiens
ugaggcaggagaaucgcuugaaccccgggagguggagguugcagugagccgagaucgcgccauugcacuccagccugggcaacaagagugaaacacugucuca

SEQ ID NO: 7142 - RNA, 102 nt, Homo Sapiens
ugaggcaggagaaucgcuugaacccggaaggcagagguuguggugagcugagauugcaccauugcacuccagccugggcaauaagagcaaaacucugucuca

SEQ ID NO: 7143 - RNA, 102 nt, Homo Sapiens
ugaggcaggagaaucgcuugaacccgggaggcggaggucguggugagccaaaaucgcaccauugcacuccagccugggcaacaagagugaaacucugucuca

SEQ ID NO: 7144 - RNA, 101 nt, Homo Sapiens
ugaggcaggagaaucgcuugaacccgggaggcggagguuguggugagccgagaucucgccacugcacuccagccugggcaacagagugagacuccgucuca

SEQ ID NO: 7145 - RNA, 100 nt, Homo Sapiens
ugaggcaggagaaucgcuugaacccggggggaggagguuacagugagcugagaucgcgccacugcacuccagccugggcaacaagagugaaacugucuca

SEQ ID NO: 7146 - RNA, 100 nt, Homo Sapiens
ugaggcaggagaaucgcuugaaccuggcagguggagguugcagugagccgagaucgcaccauugcacuccagccugggcaacaagcacaaaacugucuca

SEQ ID NO: 7147 - RNA, 102 nt, Homo Sapiens
ugaggcaggagaaucgcuugaaccugggaggcagagguuguggugagccgagaugaggucauugcacuccagccugggcaacaagugugaaacuccgucuca

SEQ ID NO: 7148 - RNA, 99 nt, Homo Sapiens
ugaggcaggagaaucgcuugaaccugggagguggagguuguggugagccgagaucgcgccauugcacuccagccugggcaagagcaaaacucugucuca

SEQ ID NO: 7149 - RNA, 102 nt, Homo Sapiens
ugaggcaggagaaucgcuugaagccgugagguggagguuuuggugagcugagaucgcgccauugcacuccagccugggcaacaagagcgaaacucugucuca

SEQ ID NO: 7150 - RNA, 102 nt, Homo Sapiens
ugaggcaggagaaucgcuuuaacccgggaggcagagguuguggugagccgagaucgcgccauugcacuccagccugggcaacaagagcggaauucugucuca

SEQ ID NO: 7151 - RNA, 102 nt, Homo Sapiens
ugaggcaggagaaucgguugaacccaggaggcagagguuguggugagccgagaucguaccauugcacuccagccugggcaacaagagcaaaacuccgucuca

SEQ ID NO: 7152 - RNA, 99 nt, Homo Sapiens
ugaggcaggagaaucguuugaaccuaggaggcggagguuccagugagcugagauggcgccacugcacuccagccugggcaacagagugagacugucuca

SEQ ID NO: 7153 - RNA, 102 nt, Homo Sapiens
ugaggcaggagaaucguuugaaccugggaggcggagguuguguugagccgagaucucgccauugcacuccagccuaggcaacaagagcgaaacuccaucuca

SEQ ID NO: 7154 - RNA, 101 nt, Homo Sapiens
ugaggcaggagaauggccugaaccuaggagguggagcuugcagugagccgagauagcgccacugcacuccagccugggcaacagagcgagacucugucuca

SEQ ID NO: 7155 - RNA, 101 nt, Homo Sapiens
ugaggcaggagaauggcgugaacccgggaggcagagcuugcagugagcccagauugcgccacugcacuccagccugggcaacagagcgagacuccgucuca

SEQ ID NO: 7156 - RNA, 101 nt, Homo Sapiens
ugaggcaggagaauggcgugaacccgggaggcggagcuugcagugagccgagaucgcgccacugcacuccagccugggcaacagagugagacuccgucuca

SEQ ID NO: 7157 - RNA, 101 nt, Homo Sapiens; identical to SEQ ID NO: 7156

SEQ ID NO: 7158 - RNA, 101 nt, Homo Sapiens; identical to SEQ ID NO: 7156

SEQ ID NO: 7159 - RNA, 101 nt, Homo Sapiens; identical to SEQ ID NO: 7156

SEQ ID NO: 7160 - RNA, 101 nt, Homo Sapiens
ugaggcaggagaauugccugaacucaggaagcggaggucgcaguaagcugagaucaugccacugcacuccagccugggcaacagagcgagacucugucuca

SEQ ID NO: 7161 - RNA, 101 nt, Homo Sapiens
ugaggcaggagaauugcuugaacccaggaggcagaagcugcagugagccaagauagugccacugcacuccagccugggcaacagagcgagacuccgucuca

SEQ ID NO: 7162 - RNA, 102 nt, Homo Sapiens
ugaggcaggagaauugcuugaacccgggagguggagguugcagugagccaagauugcgccacugcacuccagccugggcaacaagagcaaaacucugucuca

SEQ ID NO: 7163 - RNA, 102 nt, Homo Sapiens
ugaggcaggagaauugcuugaacccgggagguggagguugcggugagccgaggucgcgccauugcacuccagccugggcaacaagagcgaaacuccgucuca

SEQ ID NO: 7164 - RNA, 101 nt, Homo Sapiens
ugaggcaggagaauugcuugaaccugggaggcagagguugcagugagcugaaaucgcgccacugcacuccagccugggcaauagggcaagacuccgucuca

SEQ ID NO: 7165 - RNA, 101 nt, Homo Sapiens
ugaggcaggagaauugcuugaacucgggaggcggauguugcagugagccaauaucgcaccacugcacuccagccugggcaacagagcaagacuccgucucg

SEQ ID NO: 7166 - RNA, 100 nt, Homo Sapiens
ugaggcaggagaauugcuugaacuugaaaggcagagguugcagugagccgaaauugcaccacugcacuccagccuggcgacagagcaagacuccaucuca

SEQ ID NO: 7167 - RNA, 101 nt, Homo Sapiens
ugaggcaggagagucgcuggaaccugagaggcggagcuugcagugagccgagaucgcgccacugcacuccagccugggcaacacagcgagacuccgucuca

SEQ ID NO: 7168 - RNA, 101 nt, Homo Sapiens
ugaggcaggaggauugcuucaacccaggagcuggaggcugcagugagcuaugaucaugccacugcacuccagccugggcaacagaauaauauccugccuca

SEQ ID NO: 7169 - RNA, 101 nt, Homo Sapiens
ugaggcagggaaaucgcuugaacccaggagacagagguuucagugagccgagaucgugccacugcacuccagccugggcaacagagugagacucugucuca

SEQ ID NO: 7170 - RNA, 102 nt, Homo Sapiens
ugaggccggagaaucgcuugaacccuagaggcagguugcagugagcccagauugcaucaccacugcacuccagccugggcaacagagggagacuccaucuca

SEQ ID NO: 7171 - RNA, 101 nt, Homo Sapiens
ugaggccugagaauugcuugaacccaggagguagagguugcagugagcugagaucgcaccacugcacuccagccugggcaacagagcuagacucugccuca

SEQ ID NO: 7172 - RNA, 110 nt, Homo Sapiens
ugaggcgcccugaaaacauaggcugggcuugugugagaugggagaaagaccagaaguaucgucuaaacuucucccugcccacacauccagcuucauggcacugugcuaca

SEQ ID NO: 7173 - RNA, 101 nt, Homo Sapiens
ugaggcgggagaauggcgugaacccaggagguggagcuugcagugagcggagaucuugccacugcacuccagccugggcaacagagcgagacucugucuca

SEQ ID NO: 7174 - RNA, 101 nt, Homo Sapiens
ugagggaggagaauggcaugaaccugggagguggagcuugcagugagcccagauugcaacacugcacuccagccugggcaacagagccagacucugucuca

SEQ ID NO: 7175 - RNA, 116 nt, Homo Sapiens
ugagguaaguauguuauuggaaaggugugaucuauauagaacccuguacaugaaaaggaggagaugccgcuaucuuggcagggaugaucauguauuugaaauaguaacucacagca

SEQ ID NO: 7176 - RNA, 100 nt, Homo Sapiens
ugagguacgacaauugcuugaacccaggagguggaggcugcagugagugagaucacaccacugcacuccagccugggcaacagagugagacccuaucuca

SEQ ID NO: 7177 - RNA, 101 nt, Homo Sapiens
ugagguaggagaaucacaugaacccgggagguggagguugcagugagccgagaccacgccauugcacaccaaccugggcaacagacugagacucugucuca

SEQ ID NO: 7178 - RNA, 102 nt, Homo Sapiens
ugagguaggagaaucacuugaacccgggaggcagagguugcggugagccgagauugugccacugcacuccagccugggcaacaagagcgaaacuccgucuca

SEQ ID NO: 7179 - RNA, 103 nt, Homo Sapiens
ugagguaggagaaucacuugaacucgggaggggaggcugcagugagccaagaucacacaccacugcacuccagccugggcaacaaagugagacccccaucuca

SEQ ID NO: 7180 - RNA, 103 nt, Homo Sapiens
ugagguaggagaaucgcuugaacucgggaggggaggcugcagugagccaagaucacacaccacugcacuccagccugggcaacaaagugagacccccaucuca

SEQ ID NO: 7181 - RNA, 103 nt, Homo Sapiens; identical to SEQ ID NO: 7180

SEQ ID NO: 7182 - RNA, 103 nt, Homo Sapiens; identical to SEQ ID NO: 7180

SEQ ID NO: 7183 - RNA, 103 nt, Homo Sapiens; identical to SEQ ID NO: 7180

SEQ ID NO: 7184 - RNA, 103 nt, Homo Sapiens; identical to SEQ ID NO: 7180

SEQ ID NO: 7185 - RNA, 101 nt, Homo Sapiens
ugaggugggaggauuacuugagcccaagaggaggaggcugcagugagucaacauugcaccacugcacuccagccugggcaacagagugugaccccaucuca

SEQ ID NO: 7186 - RNA, 86 nt, Homo Sapiens
ugaguaagaggagguggggaacuuugagagacaucguaauggcuguccaccacagucuuccuccguccccaccucccagugauuca

SEQ ID NO: 7187 - RNA, 101 nt, Homo Sapiens
ugaguguaugugugagagagaauguuauguuuaucacugaguucccauuguuucauucucauagcacuuauuucuucauacuuucuauacacauuuacucg

SEQ ID NO: 7188 - RNA, 68 nt, Homo Sapiens
ugauagcaacucugcuuccuugccucaggacagguuuguggcaaggaagaaagcagaaguugcuuuca

SEQ ID NO: 7189 - RNA, 80 nt, Homo Sapiens
ugaugaaaauccacaaugucuuugagcuucugguuguguaaugcugggguuuaaagucaccauuuguggguuuggcauca

SEQ ID NO: 7190 - RNA, 93 nt, Homo Sapiens
ugaugcgccacagguaucagcgucuggaucgccacuucacguuuuagccacaagugacucaguggaagauccagagucaacagaggcucguca

SEQ ID NO: 7191 - RNA, 85 nt, Homo Sapiens
ugauggaggaaauggugguaucuuguguuauuaagcacuugaacuugguugaugcacugcagucucuaauaaauuuccaauauca

SEQ ID NO: 7192 - RNA, 86 nt, Homo Sapiens
ugauguguguguaggaaaauauuaaggugggauguguggaucaguguccuagcacauucccgcaggguguaagccuggcacuauca

SEQ ID NO: 7193 - RNA, 86 nt, Homo Sapiens; identical to SEQ ID NO: 7192

SEQ ID NO: 7194 - RNA, 96 nt, Homo Sapiens
ugauucaaagcaagaugguagcauuggagaggaugagauauggucagaugaggauauauuuuaaaaguugagcuaacaggauuugcugaggaauca

SEQ ID NO: 7195 - RNA, 86 nt, Homo Sapiens
ugcaccuucccugggacaacuuucuuauugaugggucuuguguuuaauuaaugagaguuuguuuuagggguaugggcccaggugca

SEQ ID NO: 7196 - RNA, 97 nt, Homo Sapiens
ugcaugcuggguaaaucauucugucucauuugucuguuggaaauacaguucuggcacuaagauauggugaacagacagauggaggccacaacauuca

SEQ ID NO: 7197 - RNA, 90 nt, Homo Sapiens
ugcauuacccuccccaacuuaaaaucuuuugauaacccaggcagcuggguuauccccaauuuaaagucuuuuuguuguagcuguauggca

SEQ ID NO: 7198 - RNA, 88 nt, Homo Sapiens
ugcccuguugaccagaauuuguuagauugcuauuacaaugcugauuauauuuuauagcaauuacugacauaagguuauacuuugggca

SEQ ID NO: 7199 - RNA, 97 nt, Homo Sapiens
ugccucucuggcacuuccaaucuccuaccugugauagacgucuaagugaaaguacuagcuuaguuguuugggauugguagugacagagaaaacagca

SEQ ID NO: 7200 - RNA, 97 nt, Homo Sapiens
ugccugaauaaagcuagacguucauugaccagcagagucuuuuauaacuaccccaguuccguggaaaacuugggcuggucuaaguacuguccaggca

SEQ ID NO: 7201 - RNA, 77 nt, Homo Sapiens
ugcgggcaggaucacauauuaggcagaaaacaauuccaagcaaggagaguugcugggauuauucugcucuggucgca

SEQ ID NO: 7202 - RNA, 107 nt, Homo Sapiens
ugcuaaagaaagaggggcugauuugucagacuauuuugucuauaacuaggguagccauauaugccaauuuccccaaggcagucuugauuagcuucuauuuuuuggca

SEQ ID NO: 7203 - RNA, 95 nt, Homo Sapiens
ugcuaggcuuauucucuuccucauucagucucucaaucaaucaauacuuacugaguacuugucauugcaagaccugaggaauagaggggcuagca

SEQ ID NO: 7204 - RNA, 74 nt, Homo Sapiens
ugcucuguugccuaggcuggagugcagugaugcaauuuuggcucacugcaaccuccaccuccuggguucaagca

SEQ ID NO: 7205 - RNA, 100 nt, Homo Sapiens
ugcugcauccugccuggcucccaggaggccucucucagcauuuucugacaacaaagccggggcugcagaucccuggugagauuccaggcuagcaucagca

SEQ ID NO: 7206 - RNA, 105 nt, Homo Sapiens
ugcugggcgugugaggcggcugugcugugccugugagacaggaaugguuccauuacaccaugggaaaucacugauuuauaggucccaaacugccacacaucagca

SEQ ID NO: 7207 - RNA, 103 nt, Homo Sapiens
ugcuguaggcuguaugcuguuaaugcuaaucgugauagggguuuuugccuccaacugacuccuacauauuagcauuaacaguguaugaugccuguuacuagca

SEQ ID NO: 7208 - RNA, 125 nt, Homo Sapiens
ugcuguggccuaacaguuguuuucugaguauauuuucaugucaaauagcaaaaguagaacuuuuggaggaggugugaagaaaugaagagugacuagaggaaaauagagagucagaaguugcagua

SEQ ID NO: 7209 - RNA, 72 nt, Homo Sapiens
ugcuguugacauuuccccaugugaugcuauugcuucucuuuggaggcuaagcaguaaaugggguuaacagca

SEQ ID NO: 7210 - RNA, 97 nt, Homo Sapiens
ugcuuccuuaccuacaagaaaauuuagaaguuggugcaaauggcauuuccaugaguacuucucaugcaucuuugcauauuucaccuggggggaagca

SEQ ID NO: 7211 - RNA, 87 nt, Homo Sapiens
ugcuucuaggaaccuccaucucaugccauggugcuucgaggagcguaccagccuugcagcaccacaacagggacugggcuggaggca

SEQ ID NO: 7212 - RNA, 74 nt, Homo Sapiens
ugcuugaacccaaaaggcggagguugcagugagccaagauugugccacugcacuccagccugggcaacagagca

SEQ ID NO: 7213 - RNA, 72 nt, Homo Sapiens
ugcuugaacucgggguggagguugcagugagccaagaucgccccacugcacuccagccugggcaacaaugca

SEQ ID NO: 7214 - RNA, 90 nt, Homo Sapiens
uggaacuggaggagcuguccugugucagccugaaauaaucaaaaggaucaaaaauccuguuuuaggcaacauaggaagacuccaacucua

SEQ ID NO: 7215 - RNA, 127 nt, Homo Sapiens
uggaauguucugaagaacugggugaucuugugaaaucuguggacccuacauuggcacuuaguguguaccuaagggcuaacgucccaaauaaagucauucagugcuuugcagaaacaggucaagucca

SEQ ID NO: 7216 - RNA, 101 nt, Homo Sapiens
uggacuaggacccuggaggcagaaauaguuaccgaggggaaguuacaggccugagugugagucccuguuugguugcugaugagcuuugagguccuuggcca

SEQ ID NO: 7217 - RNA, 81 nt, Homo Sapiens
uggagacugguagcuuauuaaagaaacuccguguuacucauuccuggaguuggggguuucuguaggcacuuuauuucucca

SEQ ID NO: 7218 - RNA, 86 nt, Homo Sapiens
uggagcugagauucugugggugagagagugggagagugucugugggcugagcacugguccuuucugacucacagcucuggggccca

SEQ ID NO: 7219 - RNA, 102 nt, Homo Sapiens
uggagcugcuggguaaaauaauguguacuugucuuaguuugcucuuuuccaaguugaagucuggcagauuucaccagagcacagugucugcccccaccucca

SEQ ID NO: 7220 - RNA, 96 nt, Homo Sapiens
uggaggaaugggagcuaugggcaaauacugggagcuggcuggaugccaggauacagcagccaucugccaucauuacccuagcuucaggauccucua

SEQ ID NO: 7221 - RNA, 82 nt, Homo Sapiens
uggaggaggaggcuggugcugguuaaauacaaccuaaaucaaaccacaguugaccaaccaccacauccagcuucuccuucca

SEQ ID NO: 7222 - RNA, 122 nt, Homo Sapiens
uggaguauuuaagagugacuuaaacaacagauguucauacucugccaguucuggagguuggaaaguccaagaucagggugcuggcagauuugguugcuguuggguucucuucuuggcucgca

SEQ ID NO: 7223 - RNA, 96 nt, Homo Sapiens
uggcaccagcuuccaaagccaggaugaagaggaggagaaaggaugggguccacaccuuguuuucuccaccaucauccaggggcucugcugcugcua

SEQ ID NO: 7224 - RNA, 95 nt, Homo Sapiens
uggcaggaggccagcucucauccuuuucugcaaccuguuugcucacugguuuauuuguaaauuggggcuaugagggucuacugcugucccugcca

SEQ ID NO: 7225 - RNA, 97 nt, Homo Sapiens
uggccaugcacaguggcucgcaacuguaaucucagcacuuucggaagccaaggcggucagaucaccugaggucaggaguucgagaccagucuggcca

SEQ ID NO: 7226 - RNA, 73 nt, Homo Sapiens
uggccucucugugcuuccauuuccccaucuguaagauaggaauaacacaucucacaggagcauggagaggcua

SEQ ID NO: 7227 - RNA, 95 nt, Homo Sapiens
uggccucugggacucagauuccuccucuuuaaaauggugcuaauaauagcacccacccucugugaggaggaugcugugaggacaaaaugagauca

SEQ ID NO: 7228 - RNA, 88 nt, Homo Sapiens
uggcucacaccuguaauccccgcuacucaggagguuuaggcaggagaaucacuugaacccgagaggcagagguuacaguagugaguca

SEQ ID NO: 7229 - RNA, 82 nt, Homo Sapiens
uggcuucccaaagugcuggcguuacaggugugagccaccgcaccuggccaucccggcauuuuucuauucugcugugaggcua

SEQ ID NO: 7230 - RNA, 83 nt, Homo Sapiens
uggcuuuaucucuugccuugaccuccuacauuaucaacaaagugagaguuuaagaucuccugggcaggagauuucagaagcca

SEQ ID NO: 7231 - RNA, 91 nt, Homo Sapiens
ugggaaaaaaggcaguuuagaaaaaaguacauuugguauacaugcauagagaugugcauagcaaauggucugaaugaauggccuuagacca

SEQ ID NO: 7232 - RNA, 107 nt, Homo Sapiens
ugggauuacagacaugagccacugugcccagccagggcuguguguuauguagugacagcucacugauacagcucucucuggggacuuaggaaccaaguuugacccca

SEQ ID NO: 7233 - RNA, 104 nt, Homo Sapiens
ugggcaaaaagugagaaaguaagacugugggaggugacuguuacagaucggaaaacucugauugaaccauucacuuuauuagccaguaaacuuucucaacccca

SEQ ID NO: 7234 - RNA, 78 nt, Homo Sapiens
ugggccagauaguucucuguuguugggggauuucuugugcauugugggagauuucccaucuuuccucacuucuaccca

SEQ ID NO: 7235 - RNA, 80 nt, Homo Sapiens
ugggcccaggaggcuuugagaaagccuucucuguguacucuggagauagauggagaaguguuuucagauuccugggaaca

SEQ ID NO: 7236 - RNA, 82 nt, Homo Sapiens
ugggcgccuguaaucucagcuacuugggaggcugagacagagaauugcuugaacccaggaggcggagguugcagugagccua

SEQ ID NO: 7237 - RNA, 113 nt, Homo Sapiens
ugggcugagggaaagcauguccacaccaggugcccagacaucugguuggcuuuggcugauuuguccugcaggcaccugccuugucuggauuugcacacuuuccaaguugccca

SEQ ID NO: 7238 - RNA, 113 nt, Homo Sapiens; identical to SEQ ID NO: 7237

SEQ ID NO: 7239 - RNA, 100 nt, Homo Sapiens
uggggcaggacgauugcuugagcccaggagcuuaaagcugcaguaaguggugacuugccacugcacuccagccugggcaacaaagcaagacucugucuca

SEQ ID NO: 7240 - RNA, 99 nt, Homo Sapiens
uggggccuugguaauauaggaaaccuucuugccaauauaggaauauguugacauauuagcuauagcaaaaggcuuauauuagcaccgaaugaggcucug

SEQ ID NO: 7241 - RNA, 83 nt, Homo Sapiens
ugggggcacuggcuucugcucuugcucuuucuucuggaaacauuauucuguuccuuuggacaugggcaaggguccugucccua

SEQ ID NO: 7242 - RNA, 91 nt, Homo Sapiens
ugggguacugagagucaaagacuuggcugucagcccugagucugccucaaccuccaagggucauagccacggcuucacccucugugccuca

SEQ ID NO: 7243 - RNA, 78 nt, Homo Sapiens
uggggugcucaucuucuguaacuguugggaaggcucggugguccauuuucaccaguuaaagaauaugaggccagccca

SEQ ID NO: 7244 - RNA, 64 nt, Homo Sapiens
uggguacuuuaucucacacucugauuucuugcuucgugggaaacagacuguaauauuguaagca

SEQ ID NO: 7245 - RNA, 85 nt, Homo Sapiens
uggguagcaugaacuaagguagauaaaggcuucacgugguguuuggcauggcguagguguagauuggaccucaguuuucugccca

SEQ ID NO: 7246 - RNA, 106 nt, Homo Sapiens
ugggucccagauucuuccugguggaggcauucggagagcaacacccuggccuuaacacacuacauaucuuugaauuucacacgggggcagccuucugggaaaacca

SEQ ID NO: 7247 - RNA, 83 nt, Homo Sapiens
ugggugccuguaaucccagcuacuugggagguugaggcaggagaaucacuugaacccaggagguggagguugcagugagccca

SEQ ID NO: 7248 - RNA, 100 nt, Homo Sapiens
uggguggcgugagggggaaggugugugugugggguggcagggaggagaaggaaucugcucugugcuuauucuuguccccguuucuuuugcagccugccca

SEQ ID NO: 7249 - RNA, 113 nt, Homo Sapiens
ugguagggaauuagaugucucucagaaucuuuugucucugagaagaugccuagagaaaagggaauucaauaggauaaaagucauucuccagauucacauuuauuuuccuacca

SEQ ID NO: 7250 - RNA, 76 nt, Homo Sapiens
ugguccacauucuacauaguagcacccuccacacaguggacaaugucaagagguggcacugugugggguggggcca

SEQ ID NO: 7251 - RNA, 80 nt, Homo Sapiens
ugguggaaggaaaaccugucauuccaaggacagucccaugacagggaagcugacacuucaguggcagguuaaucccccca

SEQ ID NO: 7252 - RNA, 99 nt, Homo Sapiens
ugguggcauaugcguguaaucccagcuacuugggaggcugaggcaggagaauugcuugaacccaggagguggagguuacagugagcagagauugcacca

SEQ ID NO: 7253 - RNA, 109 nt, Homo Sapiens
ugguggcuugguuuguguaccuauuuuucugcauuuguauuggaaaagguuucuuuuaagacauuuuccaaaaguggagaggaauauguguguucaggaagggcuuuca

SEQ ID NO: 7254 - RNA, 103 nt, Homo Sapiens
uggugggacacagagccagugacugacauagaagagcagugggguagaauuacaguuccaucuggugccuuuucucugagcaaagcuguauccaucaccacca

SEQ ID NO: 7255 - RNA, 113 nt, Homo Sapiens
ugguucauaauauuccuugcagauguugaacgaugggcuggauuguuuuggaaccuuguuccagcagagcccauguguucaugaagaaaacauuugcuuacagcuuaugacua

SEQ ID NO: 7256 - RNA, 99 nt, Homo Sapiens
ugguugaggccaggaauucgagacaagucugggcaacaaagugagaucccaucucuacaaaaaauuagccagacuggugggcucccuuagccucagcua

SEQ ID NO: 7257 - RNA, 106 nt, Homo Sapiens
ugguugcaaggcaggaaauauuggugaaaugcuagcaaagucacaauuucuacucugaacaugauuugcaguguucaucaguauuuuucugaacccugcuuuacca

SEQ ID NO: 7258 - RNA, 101 nt, Homo Sapiens
ugguuguuaugagucugguuguuaagugcugguuguuaguuguuaaaguagagaaaaccccuagcacagugcuuggcacacacuaaagccaucauaaacca

SEQ ID NO: 7259 - RNA, 107 nt, Homo Sapiens
ugguuuagcuuaggaacagcaucuggcacauaguaaguguucagugaacguuagcuauuaccaucaucacuauuaaugugugcuagugacuguccugaguuacauua

SEQ ID NO: 7260 - RNA, 74 nt, Homo Sapiens
ugguuucauuaaaauguguaagguuggcugggugcaguaacucaugccuguaaucccagcauuuuaggagacca

SEQ ID NO: 7261 - RNA, 76 nt, Homo Sapiens
ugguuugagcccaggaggcagaaguugcagugagcugaaaucaugccacugcacuccagccugggugauagagcca

SEQ ID NO: 7262 - RNA, 121 nt, Homo Sapiens
uguauugcagcagguuggcagccucaguaaaucuccauuuguaaaugugacagucagcagaaucuccaguuacagucaacucaaagcaagcaggggcaugccacauacauguucauauaua

SEQ ID NO: 7263 - RNA, 94 nt, Homo Sapiens
ugucccuuccaagcuguguuaacuguucaaacucaggccugugugacuccauuggggugagaggugaaagcauaacauggguacagaggggaca

SEQ ID NO: 7264 - RNA, 111 nt, Homo Sapiens
ugucuauagaguaugugggccauuuucugcccguaaaauguucaaauguuuucucucucuaaagcuuuguucauuguaucugguggaauuuugguucucagggaguagaca

SEQ ID NO: 7265 - RNA, 111 nt, Homo Sapiens; identical to SEQ ID NO: 7264

SEQ ID NO: 7266 - RNA, 111 nt, Homo Sapiens; identical to SEQ ID NO: 7264

SEQ ID NO: 7267 - RNA, 101 nt, Homo Sapiens
ugugaaacacagccaguuucuuugaugacucaaaacguacuuugugaucuugccaagcuuugagaucaucguuacaagcagcauuuugguugugaaaaaca

SEQ ID NO: 7268 - RNA, 95 nt, Homo Sapiens
ugugaaaccauuaugcagaugaagaagaugaagcccgagagguuaugaaacagacccaagugggcucgcucuucagucucggcauaaggaauccg

SEQ ID NO: 7269 - RNA, 58 nt, Homo Sapiens
ugugagccaccgcgccuggccucaaauuguuuuugaaguaguuagguuguagcucaua

SEQ ID NO: 7270 - RNA, 103 nt, Homo Sapiens
ugugagcuccugaggagucaggccugagucugugggucaucuagcacauccuuaauagaaugauugccuggaugugaccacccucacccccaacccucacaca

SEQ ID NO: 7271 - RNA, 86 nt, Homo Sapiens
ugugcauuccuuccagagcauuugugaggaguguucagcugcugcaaacaucccaugaauccucagcuacuuggaacagguguaca

SEQ ID NO: 7272 - RNA, 82 nt, Homo Sapiens
ugugccugccccaaucuuguguuuuauugcuggccaccuguagccaggcacugugcaggaugaugggauccagcaguguaca

SEQ ID NO: 7273 - RNA, 108 nt, Homo Sapiens
uguggagaauuaaaaaggguagugaggcuggcauuuauagaaucuggcuuucuuguauuggguggaaagcuagaugaaaccaguuucucucagccuuuucucuccuca

SEQ ID NO: 7274 - RNA, 92 nt, Homo Sapiens
uguggcucugccucccugucucacucucccuauaacuggccucucccugcucagaccuuccuggacgagcugcaugagacagggcagcugca

SEQ ID NO: 7275 - RNA, 78 nt, Homo Sapiens
ugugggaagaugcuggcaaggugcuggagggcccuggaggcaaagggccugccucgaccuugccccccauaacccaca

SEQ ID NO: 7276 - RNA, 79 nt, Homo Sapiens
uguggggaucuggugcugugguucugcaugaagacaguaacggugucuucauccaggaaccacauugucuggaccuaca

SEQ ID NO: 7277 - RNA, 102 nt, Homo Sapiens
ugugguccacaaggggagagcaggggacacagcauuggcaggaaccucaaauuccugaccaaacccucuuccacacaaugccucccgaaagaaaggaaccca

SEQ ID NO: 7278 - RNA, 90 nt, Homo Sapiens
ugugucagucaggauaggucaacugcuguaacaaacagcccucaaaucucaguggcugaacaccauacagcucugcuucuggcucacaca

SEQ ID NO: 7279 - RNA, 100 nt, Homo Sapiens
uguucagaaagucuguuguuguaaacauccccgacuggaagcuguaagacacagcuaagcuuucagucagauguuugcugcuaccggcuauucacagaca

SEQ ID NO: 7280 - RNA, 119 nt, Homo Sapiens
uguuccucuaagguugucauaauaagugcaucauuaccaaguauuacagcagguacugguuugcaucagggcugcugacguugucugugggcauuguuaagaaaccaaucugggaaaca

SEQ ID NO: 7281 - RNA, 87 nt, Homo Sapiens
uguugauggucucauaacugaauauauuaaaaacuuaaauuguauacuuuaaguuggugauuguaugauauaugaguuuuaucaaua

SEQ ID NO: 7282 - RNA, 88 nt, Homo Sapiens
uguuggccaggauugucuugaucuccugaccuugugaucggcccaccucggccucccaaaguacugagauuacagacgugagccacca

SEQ ID NO: 7283 - RNA, 95 nt, Homo Sapiens
uguuuugacucuccgccuucccuuaggucuggaaugguagagcauugaguacuguuaucuuccacaucucaggagaagggggcaguagagagaca

SEQ ID NO: 7284 - RNA, 101 nt, Homo Sapiens
uuacugaguauucaccaggugcuggguggagaaagaagacuuaaagauucccuagacaucuccucuccccuagacucaggaccauggcacuuauuuucuag

SEQ ID NO: 7285 - RNA, 115 nt, Homo Sapiens
uuagcaccugccuauauuacauucauuuugaugguuuguaucucaaaggaguacagugaacgaaacuuguuuaaagauacaccggaaagaaaaagagaagaggcagaguggcuug

SEQ ID NO: 7286 - RNA, 93 nt, Homo Sapiens
uuagccucccagauguccuugugcuaguuuuagcuguuuucagguguugauaaaagcuccaggagcuggcaggaggagagcagaggaagcuag

SEQ ID NO: 7287 - RNA, 84 nt, Homo Sapiens
uuaggaaaguaguuuuaaucucauaggcccccaguggggauccccugggauccucuggccaugcugugagaacugcuagccuag

SEQ ID NO: 7288 - RNA, 72 nt, Homo Sapiens
uuaugaauccguuuuuaugaaauguccaaaauaggcaaaucuauggacagaaaguagaaagcagauucgugg

SEQ ID NO: 7289 - RNA, 110 nt, Homo Sapiens
uucacccucucagccaggcuggucuugaacuccugacuuugugauccaccugccuuggccacccaaagugcugguauuacaagugugagccaccgcgccuggccggugaa

SEQ ID NO: 7290 - RNA, 81 nt, Homo Sapiens
uucacgcuugaaccugggagguggagguugcagugagccgagaucaugccauugcacuccagccugggcaacaagagugaa

SEQ ID NO: 7291 - RNA, 91 nt, Homo Sapiens
uucacucccaaguggcuuuugucuggcagauuccgguggauuaugcaaagagggacugccagagaaucugagcuguuggaagacuucugaa

SEQ ID NO: 7292 - RNA, 113 nt, Homo Sapiens
uucagccagacgugauggaggaaauggugguaucuuguguuauuaagcacuugaacuugguugaugcacugcagucucuaauaaauuuccaauaucaagaagaacaugcugaa

SEQ ID NO: 7293 - RNA, 124 nt, Homo Sapiens
uucagguacuccaugugauauaugguuccacaauccucagcguguuaacugaagccuuguugaguuuaacaaagcugccauugaagaucuggggaaagugaagaaguugcaacagaguuuuggg

SEQ ID NO: 7294 - RNA, 111 nt, Homo Sapiens
uucagguuuucagacaccugcaguaguagaacagaauauuuuagcucugaggacaaucuaaguuaugaauagucugguucuguaaggauuugcauaguuuggagaaaugaa

SEQ ID NO: 7295 - RNA, 101 nt, Homo Sapiens
uucaguauagcaaggugcuagguuuuuuccuuuccccaccugucucuuagccuggggaauuaaaugagaagccuuagaauggguggcccuugugaccugaa

SEQ ID NO: 7296 - RNA, 81 nt, Homo Sapiens
uucaguggcauugggccuuggcugggaugcugaguuauccacuggagcaucggcaguacaggcaggcacagaggcagugga

SEQ ID NO: 7297 - RNA, 130 nt, Homo Sapiens
uucauuaggaaaggguuuugaggucaggacauggguaucugguguacaugggaguuugguggccucuauuguaggaggcuuuggaaauguguauuguugggagguccugagggaggaaguuugggaugaa

SEQ ID NO: 7298 - RNA, 102 nt, Homo Sapiens
uuccaagugaaaauagacuuucuggaggagcagaaaggacagcucuugguaucuugcuguccugagaacugcuccaguuaaauauauuuguauuuagaggaa

SEQ ID NO: 7299 - RNA, 67 nt, Homo Sapiens
uuccaugggcaggggccaugacagggagauaggccacaccuuucccagguggaaccugcagauggag

SEQ ID NO: 7300 - RNA, 106 nt, Homo Sapiens
uuccauuuucucauugccugaagaucucugcugaugcuccuggagaaugacuuugggggcuuuagaaagaauauugccaguccgucucggcaaggagaugauggga

SEQ ID NO: 7301 - RNA, 86 nt, Homo Sapiens
uucccugagacucuuuaacuucuugaaaaaaguugaugcuguuuuauuugaaaaaucgucaagacuauuaaaaggcaaauagggga

SEQ ID NO: 7302 - RNA, 113 nt, Homo Sapiens
uuccgauaaaagaguugccaagacccuuggaagcuccacaguaaugggugucuuucgguguccugaugagaugacugguggcugggggccucgaggagaguuucaaguuggag

SEQ ID NO: 7303 - RNA, 130 nt, Homo Sapiens
uucuauguuauacccuggaguccugguugaggggugggggaaucagaaaaguagguuuacauuuaacauuuuucuuaacuacauucacuucuuaaaaaggaacaagaaguguaaauaaguauguauagag

SEQ ID NO: 7304 - RNA, 76 nt, Homo Sapiens
uucucugucuuccauuccccuccuacgcccccagacugugagggguguaaggaagauggaagauguugcgggaggg

SEQ ID NO: 7305 - RNA, 124 nt, Homo Sapiens
uucugaacuugggccagaucuuaaccugcugguaaagcacuggcugaggguuuagacuuucaaggaauuugagguuguuuucccugccuuauugcaacccagugucuggcugcugagaccagag

SEQ ID NO: 7306 - RNA, 105 nt, Homo Sapiens
uucugcugucuauuaugagucugacuggcacagacaucugucaaggaagaaggauucuuugagcguauuugugucagucaacugcauauauggaccacaacagaa

SEQ ID NO: 7307 - RNA, 94 nt, Homo Sapiens
uucugucuuuugaauucugucgugacuggggcuaaacaacugucacuggcaagugacaagaggcacagacagcaggggaaauaaaaagagagaa

SEQ ID NO: 7308 - RNA, 112 nt, Homo Sapiens
uucugugauggguguacgacagauuauuuugugacugcagucuguucaaaucacaucacuaagcagcgcugagaugauuuguuggugcauuaaaagguuuugcaucauggaa

SEQ ID NO: 7309 - RNA, 67 nt, Homo Sapiens
uugaacccuggaggcggagguugcagugagccgagauggcaccacugcacuccagccugggcaacaa

SEQ ID NO: 7310 - RNA, 76 nt, Homo Sapiens
uugcucgaacccgggagacagagguugcagugagccgagauugugccacugcacuccagccugggcaacagagcga

SEQ ID NO: 7311 - RNA, 76 nt, Homo Sapiens
uugcuugaacccaagaggcggagguugcagugagcuaagaucaugccacugcacuccagccugggugacagagcaa

SEQ ID NO: 7312 - RNA, 76 nt, Homo Sapiens; identical to SEQ ID NO: 7311

SEQ ID NO: 7313 - RNA, 77 nt, Homo Sapiens
uugcuugaacccaagagguggagguugcagugagcugagauugcgccacugcacuccagccugggcaacaagagcaa

SEQ ID NO: 7314 - RNA, 76 nt, Homo Sapiens
uugcuugaacccaggaggcagagguugcagugagccaagauugugccacugcacuccagccugggcaacagaguga

SEQ ID NO: 7315 - RNA, 76 nt, Homo Sapiens
uugcuugaacccaggaggcagagguugcagugagccgagaucgugccacugcacuccauccugagugacaaagcaa

SEQ ID NO: 7316 - RNA, 76 nt, Homo Sapiens
uugcuugaacccaggagguggagguugcagugagcugagaccaugccauugcacuccagccugggcaacagaguga

SEQ ID NO: 7317 - RNA, 76 nt, Homo Sapiens
uugcuugaacccgggaggcagagguugcagugagcugagauggugccacugcacuccagccugggcaacagagcaa

SEQ ID NO: 7318 - RNA, 76 nt, Homo Sapiens
uugcuugaacccgggagguggagauugcagugagcugagaucaugccacugcacuccagccugggcgacagagcaa

SEQ ID NO: 7319 - RNA, 75 nt, Homo Sapiens
uugcuugaacccgggagguggagguugcagugagccgagaucgcccacugcacuccagccugggcaacagagcaa

SEQ ID NO: 7320 - RNA, 76 nt, Homo Sapiens
uugcuugaacccgggagguggagguugcagugagccgagaucgcgccauugcacuccagccugggcaacagagcaa

SEQ ID NO: 7321 - RNA, 71 nt, Homo Sapiens
uugcuugaacccgggagguggagguuguagugagccgagaucgcgccacugcacuccagccugggcaacag

SEQ ID NO: 7322 - RNA, 81 nt, Homo Sapiens
uugcuugaaccugggagggggagguuucagugagccgagccgagauugugucacugcacuccagccugggcaacagaguga

SEQ ID NO: 7323 - RNA, 76 nt, Homo Sapiens
uugcuugaaccugggagguggaaguugcagugagccaagauugugccacugcacuccagccugggcaauaaggcaa

SEQ ID NO: 7324 - RNA, 79 nt, Homo Sapiens
uugcuugaaccuuggaggcagagguugcagugagccaagaucaugccacugcacuguagccuccugggugacagaguga

SEQ ID NO: 7325 - RNA, 75 nt, Homo Sapiens
uugcuugagcccaggagcuuaaagcugcaguaaguggugacuugccacugcacuccagccugggcaacaaagcaa

SEQ ID NO: 7326 - RNA, 76 nt, Homo Sapiens
uugcuugagccccagaguuugaggcugcagugagcugugaucacaccacugcacuccagccugggcaacagaguga

SEQ ID NO: 7327 - RNA, 76 nt, Homo Sapiens
uugcuuuagcccaggaauucgaguuugcagugagcuaugauggugucauugcacuccagccugggcaaucaagcaa

SEQ ID NO: 7328 - RNA, 88 nt, Homo Sapiens
uugcuuucuaauuggaguaacuggccuuggaaccuguagucagucauuugccucagguuuaccugccagucccaccagucuaaagcaa

SEQ ID NO: 7329 - RNA, 68 nt, Homo Sapiens
uuggagcccagaagguugaagcugcagugagcugugaucaugccacugcacuccagccugggcaacag

SEQ ID NO: 7330 - RNA, 88 nt, Homo Sapiens
uuggaguuaggauccccagguucuaguccugagucuggacucuggguaagugacucagcgauucugaaccuuguuuccuuaucuuuga

SEQ ID NO: 7331 - RNA, 87 nt, Homo Sapiens
uuggcccucucugagucugagagaguaggugugcaauaagaguuaacauuugcuaacuugcagucuuauggcuccuuacagggcuga

SEQ ID NO: 7332 - RNA, 117 nt, Homo Sapiens
uugggaaacugagguaggagaaucacuugagccccggaggcagggguugcagugagcugagauugugccacugcacuccagccugggcaacagagugaaacuccaucaucaucucaa

SEQ ID NO: 7333 - RNA, 82 nt, Homo Sapiens
uugggcccaggaggcuuugagaaagccuucucuguguacucuggagauagauggagaaguguuuucagauuccugggaacag

SEQ ID NO: 7334 - RNA, 88 nt, Homo Sapiens
uugggcuacuuauaggagugaaaauaaacucugugaugugccagcaccagcacaggcucuuguaguuuccucccaacuuugggcucag

SEQ ID NO: 7335 - RNA, 80 nt, Homo Sapiens
uuggggguuguuacaugcaugaugcugagguuugggaauauggauggucccaucacccaggugauguauguaguacccaa

SEQ ID NO: 7336 - RNA, 93 nt, Homo Sapiens
uuggguccuaguaguaccaaagugcucauagugcagguaguuuuggcaugacucuacuguaguaugggcacuuccaguacucuuggauaacaa

SEQ ID NO: 7337 - RNA, 80 nt, Homo Sapiens
uugguuagguaguggaaccuucuaaaugacgcacuaugugauuccugugucauauagaauguucuaugauucuuagccag

SEQ ID NO: 7338 - RNA, 91 nt, Homo Sapiens
uuguggauauugaaguuugaagccuguuguucaucuauagaugcacuggaugggauuggaagucuucagauuucaguaggguuuuccacaa

SEQ ID NO: 7339 - RNA, 77 nt, Homo Sapiens
uuguggucuugcugauuuugagaauggagccccagaccuuccugguguuacagcucucaaagaagacaaggacccaa

SEQ ID NO: 7340 - RNA, 76 nt, Homo Sapiens
uuguugaagggcagugaagguagguuucagguuugguuuuacaaaccuguuaacuaccuccuguccagcuugacag

SEQ ID NO: 7341 - RNA, 99 nt, Homo Sapiens
uuguugauucuguugaggauauaucccuaugaugucccugggaagcgauggggcauucccagucaucugggaugugcaguuucuaaauauuaucaaugg

SEQ ID NO: 7342 - RNA, 87 nt, Homo Sapiens
uuuaguuuuaaggaagugucucuuggcuggccccuagauagcuuuaggaugggagcuagucaccagaaacaccaauccuugauuaga

SEQ ID NO: 7343 - RNA, 92 nt, Homo Sapiens
uuugagauuuuauugaguacuacuaaucuugacauauuuugguuggcaccacauucuugguauaguggguuagugguugaauaguuugcaga

SEQ ID NO: 7344 - RNA, 107 nt, Homo Sapiens
uuugauagauuuuucccuccagaauguuugcaucuauucacaugugcaucagcagugcauuuguaguuaaauguguaguuaacguucuguuuuuaaaacuauacaaa

SEQ ID NO: 7345 - RNA, 117 nt, Homo Sapiens
uuugcgcuauuaaaggcaagcugauauaaauuagaacucuucugaaugggccuucuauauuuaaaugggcuuuuucuaggaaguguauauuuguaaacuugucuugaauggaaaaaa

SEQ ID NO: 7346 - RNA, 52 nt, Homo Sapiens
uuuggaguaauucaguauagguucguuuaaaagagauuuuuauaacuucaga

SEQ ID NO: 7347 - RNA, 89 nt, Homo Sapiens
uuuuagcauggcuuguaauagcaaacaguuuguaauagcaaugacguguuauuuauugcagcauuguuuguaauagcaaaauacuggaa

SEQ ID NO: 7348 - RNA, 112 nt, Homo Sapiens
uuuucaauuuuuaaaaauuagauuuauugcagacuggccucaagcucccagacuauauuuuuuagcugcauuauuuagggguugaaaugccagcuuuugagacuuuugaaaa

SEQ ID NO: 7349 - RNA, 108 nt, Homo Sapiens
uuuugagauuuuauugaguacuacuaaucuugacauauuuugguuggcaccacauucuugguauaguggguuagugguugaauaguuugcagacuuugugaaacaaaa

SEQ ID NO: 7350 - RNA, 106 nt, Homo Sapiens
uuuuggcccugugcucuugauaacagaguguuugagggacaacuuucacauuugaguuuuuccaaaauuaaagguuguagaagagucacaguaucuauugucaaaa

SEQ ID NO: 7351 - RNA, 113 nt, Homo Sapiens
uuuugguaaagacauucaucucagucguuucucucucccagcuugaccuuagguuaauauuucauuugggucaagaaaagaauauguaggagagcuauguugcuuuaacaaga

SEQ ID NO: 7352 - RNA, 22 nt, Homo sapiens
uagcuuaucagacugauguuga

SEQ ID NO: 7353 - RNA, 22 nt, Homo sapiens
uucacaguggcuaaguucugca

SEQ ID NO: 7354 - RNA, 22 nt, Homo sapiens
aaagaauucuccuuuugggcuu

SEQ ID NO: 7355 - RNA, 22 nt, Homo sapiens
aagugcuguucgugcagguagu

SEQ ID NO: 7356 - RNA, 22 nt, Homo sapiens
ucaaguaauccaggauaggcug

SEQ ID NO: 7357 - RNA, 22 nt, Homo sapiens
aacggaaucccaaaagcagcug

SEQ ID NO: 7358 - RNA, 22 nt, Homo sapiens
ggcaagaugcuggcauagcugu

SEQ ID NO: 7359 - RNA, 22 nt, Homo sapiens
uauugcacuugucccggccugu

SEQ ID NO: 7360 - RNA, 22 nt, Homo sapiens
aucacauugccagggauuacca

SEQ ID NO: 7361 - RNA, 22 nt, Homo sapiens
gaaguuugaagccuguuguuca

SEQ ID NO: 7362 - RNA, 22 nt, Homo sapiens
cacugcacuccagccugggcaa

SEQ ID NO: 7363 - RNA, 22 nt, Homo sapiens
uagguaguuuccuguuguuggg

SEQ ID NO: 7364 - RNA, 22 nt, Homo sapiens
ucacagugaaccggucucuuuc

SEQ ID NO: 7365 - RNA, 22 nt, Homo sapiens
uaaggugcaucuagugcaguua

SEQ ID NO: 7366 - RNA, 22 nt, Homo sapiens
cuagacugaagcuccuugagga

SEQ ID NO: 7367 - RNA, 22 nt, Homo sapiens
uaauacugccggguaaugaugg

SEQ ID NO: 7368 - RNA, 22 nt, Homo sapiens
uagcagcacauaaugguuugaa

SEQ ID NO: 7369 - RNA, 22 nt, Homo sapiens
aaagugcucauagugcagguag

SEQ ID NO: 7370 - RNA, 22 nt, Homo sapiens
uuuccacagcggccaauucuuc

SEQ ID NO: 7371 - RNA, 22 nt, Homo sapiens
agcugccaguugaagaacauuu

SEQ ID NO: 7372 - RNA, 22 nt, Homo sapiens
aaguuaagagcucccaggccug

SEQ ID NO: 7373 - RNA, 22 nt, Homo sapiens
acugcacuccagccugggcaac

SEQ ID NO: 7374 - RNA, 22 nt, Homo sapiens
guguuccaggaagucgucuuga

SEQ ID NO: 7375 - RNA, 22 nt, Homo sapiens
ucaagcucauuccucuaaccuc

SEQ ID NO: 7376 - RNA, 22 nt, Homo sapiens
cauugcacuccagccugggcaa

SEQ ID NO: 7377 - RNA, 22 nt, Homo sapiens
acaugaucuccucacucuagga

SEQ ID NO: 7378 - RNA, 22 nt, Homo sapiens
aauugcuugaacccaggaagug

SEQ ID NO: 7379 - RNA, 22 nt, Homo sapiens
uguuuaaguagcuuauuuaucu

SEQ ID NO: 7380 - RNA, 22 nt, Homo sapiens
ucuaagagaaaggaaguucaga

SEQ ID NO: 7381 - RNA, 22 nt, Homo sapiens
gaaggcaguagguuguauaguu

SEQ ID NO: 7382 - RNA, 22 nt, Homo sapiens
aucacauugccagugauuaccc

SEQ ID NO: 7383 - RNA, 22 nt, Homo sapiens
uuggaguaauucaguauagguu

SEQ ID NO: 7384 - RNA, 22 nt, Homo sapiens
aguagacaguggcaacauaguc

SEQ ID NO: 7385 - RNA, 22 nt, Homo sapiens
cuagccuguuuguccucacccc

SEQ ID NO: 7386 - RNA, 20 nt, Homo sapiens
ugaggugggaucccgaggcc

SEQ ID NO: 7387 - RNA, 17 nt, Homo sapiens
uggcuagguaagggaag

SEQ ID NO: 7388 - RNA, 23 nt, Homo sapiens
aaucaucauuauuuugaaguuua

SEQ ID NO: 7389 - RNA, 17 nt, Homo sapiens
uaaggcauuuuuauggu

SEQ ID NO: 7390 - RNA, 22 nt, Homo sapiens
gcuguuguuaagggcacuuggg

SEQ ID NO: 7391 - RNA, 22 nt, Homo sapiens
uucaugggagcaggugguacag

SEQ ID NO: 7392 - RNA, 22 nt, Homo sapiens
acugcacuccagucugggugac

SEQ ID NO: 7393 - RNA, 22 nt, Homo sapiens
ucacugcaaccucugccucccg

SEQ ID NO: 7394 - RNA, 22 nt, Homo sapiens
cagaucacauccauccgucacc

SEQ ID NO: 7395 - RNA, 22 nt, Homo sapiens
gcacucaagccuggguuacaga

SEQ ID NO: 7396 - RNA, 22 nt, Homo sapiens
agagaguggcaggucuguuccu

SEQ ID NO: 7397 - RNA, 18 nt, Homo sapiens
gaugaggcagcacuuggg

SEQ ID NO: 7398 - RNA, 22 nt, Homo sapiens
ugaggugggagaauugcuugaa

SEQ ID NO: 7399 - RNA, 22 nt, Homo sapiens
cauguaaucccagcuacucagg

SEQ ID NO: 7400 - RNA, 22 nt, Homo sapiens
uagcaccauuugaaaucgguua

SEQ ID NO: 7401 - RNA, 22 nt, Homo sapiens
cagugcaaugaugaaagggcau

SEQ ID NO: 7402 - RNA, 22 nt, Homo sapiens
uguaaacauccuugacuggaag

SEQ ID NO: 7403 - RNA, 87 nt, Homo sapiens
cccgugaggaacaguggcgggauugucccagggccccuuccagcagggggaccuccugacuugagaguccccaaagccuucccaggg

SEQ ID NO: 7404 - RNA, 90 nt, Homo sapiens
cuccaccuguuugcuagcauaacaggcgugaaggcggcagugucgccggcguccuuccgcggaagcccagugugugcagacagcacgggg

SEQ ID NO: 7405 - RNA, 60 nt, Homo sapiens
uggguuccuggcaugcugauuugugacuuaagauuaaaaucacauugccagggauuacca

SEQ ID NO: 7406 - RNA, 126 nt, Homo sapiens
ggucgcgcucacugcagauuggagaacaggugcaucucguagcucuucuuuggaaaacaaaagaagccaccagcugaggaagaugcucaccggucaccgucccuuuauuuaugcccagcgaugacc

SEQ ID NO: 7407 - RNA, 74 nt, Homo sapiens
aggugcaggagcuuagcugauuggugaacagugauugguuuccgcuuuguucacaguggcuaaguucugcaccu

SEQ ID NO: 7408 - RNA, 88 nt, Homo sapiens
cucuaacaaggugcaggagcuuagcugauuggugaacagugauugguuuccgcuuuguucacaguggcuaaguucugcaccugaagag

SEQ ID NO: 7409 - RNA, 81 nt, Homo sapiens
uggggacaguuaaguuggagccgcuggggcagaggccguugcugacgggccggccgcugcugcacagucagcuugggugcg

SEQ ID NO: 7410 - RNA, 80 nt, Homo sapiens
ggucaaauguauugaaaguugcaaaaauucuucuuacaaacauaaagugugcugaauccacuacguaaaccaaaaucaaa

SEQ ID NO: 7411 - RNA, 82 nt, Homo sapiens
ggcugugagcggggcggggcggggcuuucggaggagcuccuguuguucugggcgcggugaacucucucuuguauuugcaguc

SEQ ID NO: 7412 - RNA, 68 nt, Homo sapiens
cuccggugccuacugagcugauaucaguucucauuuuacacacuggcucaguucagcaggaacaggag

SEQ ID NO: 7413 - RNA, 86 nt, Homo sapiens
uagcagcuauuguguacgcaaagccugaguacagccugcuggugucauggccacgugugagcaggccagcgucacacggcucgcug

SEQ ID NO: 7414 - RNA, 705 nt, Homo sapiens
cccuuauuagaggauucugcucaugccagggugagguaguaaguuguauuguugugggguagggauauuaggccccaauuagaagauaacuauacaacuuacuacuuucccugguguguggcauauucacacuuagucuuagcaguguugccuccaucagacaaaguuguagauguuccuuggauaauuuggacuggaagaaaagagacauggaaggggacagaugguguuuagggugaggcagaugucauuauaaagugacuugucuuucauuaauuggagcauauaauuauuuuaccuuugggcaugaacucauuuugcuauucuucaacuguguaaugauugcauuuuauuaguaauagaacaggaaugugugcaagggaauggaaagcauacuuuaagaauuuugggccaggcgcggugguucaugccuguaaucccagcauuuuugggaggccgaggcggguggaucaccugaggucaggaguucgagaccaaccuggccaacacggcgaaaccccgccucuacucaaauacaaaaauuagccaggcuuggugacacucgccuguggucccagcuacucaggaggcugaggcaggagaauugcuugaacccaggaaguggaggcuucagugagcugagaacacgccacugcacuccaguccugggcaacagagcaagacucugucucaggaaaaaaaaag

SEQ ID NO: 7415 - RNA, 80 nt, Homo sapiens
gugagguaguaaguuguauuguugugggguagggauauuaggccccaauuagaagauaacuauacaacuuacuacuuucc

SEQ ID NO: 7416 - RNA, 22 nt, Homo sapiens
ugagguaguaaguuguauuguu

SEQ ID NO: 7417 - RNA, 100 nt, Homo sapiens; identical to SEQ ID NO: 6416

SEQ ID NO: 7418 - RNA, 24 nt, Homo sapiens
aauugcuugaacccaggaagugga

SEQ ID NO: 7419 - DNA, 18 bp, artificial sequence
  Synthetic
tttaaccgcatccttctc

SEQ ID NO: 7420 - DNA, 20 bp, artificial sequence
  Synthetic
tactaatacgactcactaaa

SEQ ID NO: 7421 - DNA, 30 bp, artificial sequence
  Synthetic
gactagctggaattcaaggatgcggttaaa

SEQ ID NO: 7422 - DNA, 30 bp, artificial sequence
  Synthetic
cagccaacgctgcagatacgactcactaaa

SEQ ID NO: 7423 - DNA, 50 bp, artificial sequence
  Synthetic
  misc_feature (50)..(50): n is a, c, g or t
  misc_feature (33)..(33): n=i
  misc_feature (37)..(38): n=i
  misc_feature (42)..(43): n=i
  misc_feature (47)..(48): n=i
aattaaccctcactaaaggctgcaggtgcaggngggnngggnngggnngn

SEQ ID NO: 7424 - DNA, 20 bp, artificial sequence
  Synthetic
ggaattcaaggatgcggtta

SEQ ID NO: 7425 - DNA, 10 bp, artificial sequence
  Synthetic
  misc_feature (3)..(4): n is a, c, g or t
  misc_feature (8)..(9): n is a, c, g or t
ggnngggnng

SEQ ID NO: 7426 - DNA, 12 bp, artificial sequence
  Synthetic
tttaaccgcatc

SEQ ID NO: 7427 - DNA, 12 bp, artificial sequence
  Synthetic
cgactcactaaa

SEQ ID NO: 7428 - DNA, 40 bp, artificial sequence
  Synthetic
taatacgactcactataggcccttattagaggattctgct

SEQ ID NO: 7429 - DNA, 41 bp, artificial sequence
  Synthetic
aattaaccctcactaaaggtttttttttcctgagacagagt

SEQ ID NO: 7430 - DNA, 42 bp, artificial sequence
  Synthetic
taatacgactcactatagggtgaggtagtaagttgtattgtt

SEQ ID NO: 7431 - DNA, 41 bp, artificial sequence
  Synthetic
aattaaccctcactaaagggaaagtagtaagttgtatagtt

SEQ ID NO: 7432 - DNA, 20 bp, artificial sequence
  Synthetic
gaggcaggagaattgcttga

SEQ ID NO: 7433 - DNA, 38 bp, artificial sequence
  Synthetic
aattaaccctcactaaaggcctgagacagagtcttgct

The invention claimed is:

1. An isolated nucleic acid selected from the group consisting of:
   (a) SEQ ID NO: 6527;
   (b) a DNA encoding (a), wherein the DNA is identical in length to (a); and,
   (c) the complement of (a) or (b), wherein the complement is identical in length to (a).

2. An isolated nucleic acid selected from the group consisting of:
   (a) SEQ ID NO: 15;
   (b) nucleotides 80-97 of SEQ ID NO: 6527;
   (c) nucleotides 80-98 of SEQ ID NO: 6527;
   (d) nucleotides 80-99 of SEQ ID NO: 6527;
   (e) nucleotides 80-100 of SEQ ID NO: 6527;
   (f) nucleotides 80-102 of SEQ ID NO: 6527;
   (g) nucleotides 80-103 of SEQ ID NO: 6527;
   (h) a DNA encoding any one of (a)-(g), wherein the DNA is identical in length to (a)-(g), respectively; and
   (i) the complement of any one of (a)-(h), wherein the complement is identical in length to (a)-(h), respectively.

3. A vector comprising a human insert, wherein the human insert consists of the nucleic acid of claim 1, and wherein the vector does not comprise a human insert other than the nucleic acid of claim 1.

4. A vector comprising a human insert, wherein the human insert consists of the nucleic acid of claim 2, and wherein the vector does not comprise a human insert other than the nucleic acid of claim 2.

5. An oligonucleotide probe of 131 nucleotides in length, wherein the probe comprises the nucleic acid of claim 1.

6. An oligonucleotide probe of 18-24 or 50-120 nucleotides in length, wherein the probe comprises the nucleic acid of claim 2.

* * * * *